United States Patent 12,491,220 (COMPOSITIONS CONTAINING INDOLE-DERIVED METABOLITES AND METHODS OF USE THEREOF) - sequence listing, part 4

SEQ ID NO: 10 - DNA, 3704609 bp, Bacillus pumilus (residues 1-1,852,305 of 3,704,609)
  source 1..3704609: mol_type = genomic DNA
ccgtctctcagagacgactttattaatataacattctatcaagttgaagtcaacaacttttttctttatgttatttaataaccgcgctgttttagcggcgaatacaaatataacaccttttgagagaggaaacaagtattttttctaaataatttatttttcattatctcttcctatataatcatacaaaaattgattgtcacaggaattctctattgttgatcctgaatgtctttagtatatttataatagaagaaaactaaataaccgcagggggagctttgtgctgagagtgaacactcgttgttctgaccctttgaacctgtcagttaatactgaagtaggaatgtggattctattgaatacatgtggtgtattcaactcgatatgtttttctatgaataacatactcatccttacacggtctctccttgctcaattcatgaaaagggagatttttttatgcagcaatcaaatcaattggtacgactgatggaaatcgcaattatgacttcacttgcactagtattagattacttatcaggcctctttttaagaatgccgaacggcggatctcttgcgctgattatgatacccgtcattcttatgtctattagatggggaatatcaaccgggtttatcattggtgtgcttattgcaggccttcagctgatgaatggccctattatcgctacaccagttcaaggatttctcgattatttcgtcgcatctgttgtcatttccctaagcggcctttttgctggattgattaaaaaagccattcaggatcaaaagcgaaagcagcaattcttctatattaccttatccgtatttgttgcaagtttcttcagactgttgacgttctttatttctggtgttgttttcttttctcagtatgcaccaaaaggaacaccgggttgggtttattctttaatttataacagcacatatatggttccttcatttattatttgcagtattgttctttgcatactcataccaagtgcatctcgtttggttttccctcacaaaaaataactggctgatttcagctggttatttttttatgcataatttgccgctctatggaatctattaatagtagaagatttcatgttggaggtacgccaatgaacccttactccattatgctgtgctgttatattctcagtcttgcttattttttggccggtttctatgaagctttaaaaatagcaggaataaaaggaaaagtagaagcttctcctcttatctcttatatgctgctagctgtgcttttcacttttttctctcattattattggaagctgacgatttaattcggtgtacatggtcatttaataccggcagctcccacccataccctatttcattatgcttctcgccagccagctcgaactggctggtaacgacaaaatgaggttgaagcttttgataaaaatgctttgccgaattttgttcaaacacccacagcattatattctgataccctttctctattaaaaaacgcactccttctgaaattaaagcaatacctgctcctgatttctgtttctcttgcaatagatagatcgcataaagttctccatcatatgttggatagcgctcatcacgttgttttccaaaagaagcaaaaccaaataccccctcgtcatcttctgcgacaaacgtcccttcaagtgaccttcttctccagctctcttccttatcttctatctgtaaaccatccaaataatcctgattaataatgccttgataagtcgtctgccagctcttcacatgtatttcggcgattttaggaatatcttgttgtacagcatgtctcaccttcatccgcgccactccttctcactgttttcactctatctttattatgataaattcctatttcctaaaattcaatcaataattgatatctgttgacattttgtcaacacgcctttatattgggtacgacttcttctatagaagagttgatacatcatacaaaggatgacgtaaaatggatactaaaacaactgagcttgggcacctcttaaaggaaagattgcaacaacgatctctatctttaagagagctcagcacatacacagaaattgataaagcgacactgtctcgaatcatgaatggaaaaagaaaaccaactttgaatcatctgcagcgactttcagattctctgaacctatcattagatcaactattagctggtgcagggtttccaatcaaaaacgaaaaagtatatagtgatacgttcatacaaacggtcgtagagatcgaaacaacactgaaagatcaggaggtctacgacggtacatttagtcaggccaaattgaaacaaaagctaaacgaatatgagacctatagccaaacaaacgagggaaaagaaacgatatcggcaaagtttgaaaaaaagatggagacgctaaacggcgtcggaccattccttcagcatttgaatgacatgtacagcttatttatgaccagacgaggtacttctcgagaattaatgctgatgggaggggcactcctttatttcattatgcctgttgacttaataccagattatatttttccgatcggctacattgatgatgctgcggctgtgaaaatcgtcatagagcagctgacaaataggtaacaggaaaagaagctatgaaaaaacagtacagcattgacttcatccttttactcactgtgatttgtttatttgtcatcagcctgatagctgtatatagcggatcgggccagtatgaaacgcaggatatgttttatttcgtcaaaagacaaatcttctggtatatcgtcggctttggtctcatggcaatagctgcatactttgattatgaattgcttgagcggttatcttttcggttatttgcaggtggtattttcctcattattcttgtgcacttttttggaacgagtcaaaacggatcgcaaaggtggatcagcttcggttcaatcaaagttcagccatcagagttcatgaaaatttttatgatattgcttctagcggctgtgctgaaccaatacaagcaccggcgcttttcgtttaaagaaagcatcattcctacaagtaaagtcgtttgctggaccgttgtcccttttttcctcatcttaattcagcctgatttagggacagcgctcgtgatattatctatcgcctttacactgatgcttgtgtcagggatttctagcaagatgatggccgcattaaccgcttcttttctggcacttctttcatttttggtctacttacacaacgagcactttgagcatttcacaaaaatcattaagcctcaccagcttgatcgcatttatggctggctctctcccgatgaatttgattcgacatacgggtatcagctgaaacaatcgatgctcggcattggatcaggtcaattatcaggaagcggttttacaaaggggcatcaagtacaaggcggtaatatccccgaagcgcatacggattttatatttgccgtcattggtgaggagtttggttttatcggcgcttcccttttgatgtgtttgtacttaacgatgatttatcgaatcattcatgtcgctatgcacgcgaatacgctttatggcttgtacatatgtgcaggagtcgttgggctgatcgtgtttcaagttttccaaaacgtagggatgacagtcggtttaatgcctgtgacgggactcgcgcttccttttatcagctatggaggcagtgcgctattgactaacatgatcgccattggcctcgtgtttagtgtcaatatcaggtcatcatcctatatgtttggagacaattggaattgaagatggtggcatttcttctatctcatctcaaaagagtcgacctcgttcttgttggaacaattgtattcctcagtttatttggcttactgatggtttacagtgcaagttatcctttaggagaagtgaagtatgagaagggcagctatttctttatcaaacaatggcaatggctcctgattgggggattctttttcttcattgctgctcttttcccttatcagatttatcgtaaatggatgaaatggcttgtcatgctgtcattgctatgtctcatcctagtcctgattcctggaatcggtgtcgtcaaaaacaattcacagcggtggattcagctgggttctcttatgctccaaccatctgaagctgtgaaactagtgatggtgatttattttgcctatgtgtacgcgaaaaaacaggcgtacattacatcttttaaaaaaggcgtactgccgccactcatccttttaagtcttgtatttttattaatcttgaaacagcctgatttaggcacagctgtgtctattttgttgagctgcggcattattttattgtgcgctgggctgaaaacgcgccatctcattttgctaggatcgactgccgcagcgggcatcactttttttgcagtgacagctccttaccgtttgaagcggctgacttcttttcgtgaaccttttcagtatgaagatggagatggctatcagctgattcattcttatctcgcaatgaattcaggcgggctgacagggaatggcttaggtgggagcattcaaaagctaggctttcttcctgaagcgcatacggattttattatggccattatcagtgaagagctaggcattatggggattttgattgtgatgggcgcatatctactcatcatgtatcgcgcattgcgaattgtgcaggctttacatgacccttttggaaaactgttaacgattgggcttacgtttcaaatcatgctccaagcagtctttaatttaggcgctgtctttggtcttcttccgatcacaggcattccgcttcccttcattagttatggcggctcctccctagtgttcatgatgatatctgctggtattctcgtaaatctttcttcatatgtaaaaaggcatccatatcgagcgtatgccaaatagacaccttctgatggaaggtgtctattgattttattcttctatttgagtatcagcgatctctttttttcttggctgtttgatttcattcgttagttcctgaatgctttgcttcacattacctttgccggaaaagttctcaataatttctttgacatcaattccagaggatgctttcagactttcttgcagactggacatgagatttgtagcatagccagtgactttattggcaccgctgccttctccgttacctcccgtatccacaactgtaattttatcaatgttagaaagtggtgcagatacttgcttcgcatattcaggaagcattttcacaatcatatcaaggattgctgcctgaccatattgttcgaatgcttcagcgattttctctttcgcttcggcttccgcaagtcctttcagtctaatgacttcggcttccgtttccccttttgcacgatcagcttccgctttagcaagcccgtcaattcggactttctcagcttctgcttttgccattgcttcaatgctgtatttcttggcatctgcttctgcgaggcgtttcgctttttccgccgcagctgactgctcaaccgcataacgatccgcatctgctttctttttcacttcagaatcgtattgacgctcacgacgctgaatctctttttcttctaattcaatttgcttctgacgttcaatgatttttacttgcatttcttgttcagttacgtgctgacgattacgagctgtttcaagatcgtacgcttggtcggcacttgcttttgctgtatcttgttcacgtctgaattctgctcttttcagttcattgatcttttctgcttcagcgatttcagtggcacgctcaagctcagatttcttcgcatctttatctgcttctgcacgtttgatacgtgtttctttatctgcttctgctgttgcgatatctgcatcgcgtttcacttgggcaattctaggtttacctaatgattctaaatagccatttttatcacggacatctttgatggtaaacgatacaatgacaagacccattttcgctagatcttgagaagcgacacgctgtacttcttgagaaaatttctctctgtttttataaatctcttcaactgtcattgaccctaaaatggagcgaaggtgtccttctagtacttctctcgcttcgttttcgcggtcttcttttgttttacctaaaaattgctctgcagcagtagcaatttcttcaatcgatccgccaattttaatgatggccgttccgtccgccatgactggtacaccttgttcagtatagacttcaggtgttgaaacatctagcttgctagatagtaagctgagcggctctgcttgttgaaaaacagggagtacaaaggtacctccgcctcttacaatcttaatcttgtttccaccttcatccacgtggacatttttacttccgagataacttcctgtgacgattaatgcttcatctggaccagctgtccggtatttcgaaacaaatacaccaataagtgcaattagaatcacaagcacaattccaatgataattaaaatggttgttcctggcatagcattccctcctagatttcttcatttggtataactgataagacgcctttgttcacttcgacgaccagcacccgggttccatatggaatctcctcttcgtcgaaactgacggcaggctttgagattttcccgctattactaattaacagcacttctccaaacccgtcttttggaacagatacaatgatctccccagttcttccttttaagtcggcctccgtatatgagagagattcttcagcagaggaaagcgggactaagacaaatacattcaaacaggtcacaagaaccactgcgaggatggcagataagactgcaccaagtccactccctacaattgctgtcttttcagagataaaccctccagccgagaaaaaggtaagaaatgcgaggattaatgttggttgaaggaatggaacaggaatcgcttcaaacaatccatcaaatacatcgccgaaaaagacgaaaacaagtgtcaggattcctgatatcatcaatatgtataaatatagcgtctgaagtggcagcccgaacacatccatcttcctcaccctttcttcatgaaatgaacagcctttgtttcatttagaccatgctcacctccaatgtattccttctaacaggtaatacgaaccacttttgtaaaggtttcaaatttcctcacaattcttcacaggaattcaacgatagctcaagaatgattgtcatgtacccgtatgttaaaatttgatcttgaggtgatggaaatgagtttattacatgatgcaagacaagaattgtggcaagagctgcaaggtttgaacgaagaacaattgaatcaaaaattatctgatgatacttggagtattcaagaggtggcagatcatttaaagaagatggacctcgtggcagcaaaacatctagctgctgaggggaaaaaagcaccgattaaagaatacgagccaaagccggtggaaatggcagaggatcgttcgaaaaaagccactgcgcccagtattgttgagcctgagcacaagcatgtgacacctacacatttaaaggatgagctcgatacagcacgtgagaagctcaatcaaattttatcaacatttactgaggatgatttcaagcgagtcattgctcatcctgtgtttgaagaattatcccttaagcaatatcttgattttatcggcgcacatgaaaaacgccatattcatcaaatcaaagaaattaaagaacagttataagacataaaaagactcccttttgggagccttttttcattgttacactgttttaggcgttagatcaaaacagcgcgcataaatccagttgtacgctttttcgtttagatctcttgggtttccaattgtttgcggatctttcattgcttctttagataagcggtcaatcatatcttttgatacaccttgttcttctaatgaaggaacttctaggtcttccactaaatcatacatccagttcactgctgctttggcggcttcctctgttgacattcggctaatatcaattccaaatgcttgcgcaatacgagcaaatttttcgggataccccttccagttatactccatcaccggtcccatcattgctgcaacacactggccgtgcgctacaggaataatgcctccgagtgtttgactcatcgcatgtgcagcacctgctgattcgcttccataagaaagcccggcaagcattgcagcttgtgccattccatatctggcttctaagtcttcgccatcagcaaaggcacggcgaatgtaatgagctgcatattcaatggccatgagcgcgaccgcatctgtaatgggctgagcaaatttcattgtatagcattcaatggcatgtgcaagtgcatcaattccagtcattgctgtcacatgaggcggcatggatacatgaagctctggatcaatgacggtgaggtgagctgcaatgagcgggccacctgtgttgaatttgaattctctttcttcatctgtaattactgcccactgcgtcacttctgaacctgtaccagccgttgttggaatagtagttaaaggcgggattctcttttcaagcggttttttcccctctgccgcttcgtaatcaaggactgagccttcatgcgtcgcttctacaccgatcgccttcgctgtatccattgagcttccgccacctactgcgactaatccattacagccttctttttcatataacgaagagccttcattcactaaacggactggcgggtttggctctactttatcaaatagcaccacatcgatttgtgcttcttttaatgaagcaatcactggctctaccacacccgcttggtaaatacctgggtctgttacaagcaatacctttgaaacaccgtatgcttttacttcttccccaacatgtttcactgcaccgatgccatgtttaatgacagtcggaatttcaaacgtatggaatttttgcatgctttcaattttcatatttaatgtcataaagaatctcctccaaatgtgtgatttttattgaaaccagcgaattgcttcaggttttgtattacgatatacatgcttcagctccgtatattcctcgagcccggtgcgtcctaattcacgtcctagtcctgattgcttatatccaccccaaggagcttgagcgaaataaggatggaaatcattgatccaaactgtgcctaatcttaattgacgagcgactctttcggccttgctgatatcagtagaccacacggctcctgctaatccataaatcgtatcgtttgccagctcaatcacttcttcttctgtacggaaggattcaactgtcaatactgggccaaagacttcttcctgaacaatccgcatctctgacatgcagcctgagaaaatcgttggcaagtagaagaacccatttgaaagctcctctgcgtcaggtctttttccgcctgtttctaatttggcgccttcatctaacccaatgctgacgtatttttctactttttctcgatgctcagctgagatgagcggtccgctctgggtttcttcatcaaagccgttgcctagcttgatttttttcgtacgcttcaccagttcttctaaaaattcatcatgaatggattcttccactagcaaacgtgaacctgctgaacacacttgtcccgcatggaaaaacacagcattcattgcctggtcaaccgctacgtctaaatcagcatcttgaaacacaatattcggatttttcccgccgagctcaagggcgattttcttcacattcccactggctccctgcatgattttcttacctgtttcaataccgcctgtaaatgaaatcaaatcgacatgatcatttacagcaagctcatcaccaaccgttgcacctggtccaaggactaggttcgcaacccctgctggaatgcctgcttcttccatgagtttgaatactttgatcgtagtaagtggtgtgatttcacttggttttaatacgattgtgttccccgctgcaagagcaggtgcgattttccagcttgcttgaagcaatggatagttccatggagtaatttgcccgcatacaccgacaggctctctgaccaattcgcttttagagttctgaattggcgatgcaatgatttccccgccatctttgtctgcaagccctgcataatattggaacacgttcgcaatatcgtccatatcagctttgctttcctctactgtttttccagtatcaagcgattctaatttggctagttcatcaagatcacgcctaatcaattcagcaatcttaaacaccatatttcctctttcaagtccaggcaagtttgcccaatcaccttgatcgaaggcttttctcgctgctttaatggctagctgcgcgtcatttcttgatccttcactaactgtcgcgatcacttcttgattaaatggattaatgatatcccgcgtgtcgccacttttggcgccaacccattgtccatctataaatagtgtttgactcatagaaggaacctcctctgattctctttgataagtttgttaaataaaaatttaacgttttgaacataattaacgtatcatgttcaaatttttctgtcaaagggagatatgcttcattttcttttgacattttgcattctttcgttaacatatagtccataaagatttttttgaacgtattgaattctcttaatagaaagcagggacaagatgaaaaagcaggaacagccgcaagcagaagagcgtattttagctgctaaagatctagtcattgattccatagctgaaacgatggatctctatggaattacacgaagtgctggtattctttatgggaccatgtatttaaatgaagaaatgacgctggatgaaatgcgtgaagagctgcaaatgagcaaaccaagtatgagtacgggtgtgaaaaaactgcaagacatgaatattgtcaaaaagacctttcatcgaggacgaagaaaacatagctttgttgctgaaaaggacttttttaagtttttcatgaacttctttccgcaaaaatgggaacgagaggtcgaggtcaatttagcggcaattgaagaagcacaagtgcggcttcaagaggtggctcgtgatgatcagctggaggaacatataagagaggaagcgcagcagctcattgagcagcttgaaagttcaaaagcctactatgactggctgagacgcttagcagactctgttcattcaggggaaatctttgactatatcccgattgatcagaaagataaatagacaatgtgtgtgcgttttaaagcttgaattttacaggaggattgattataataaattatgtcgtaatacatcggggcattagctcagctgggagagcgctacgctggcagcgtagaggtcagcggttcgatcccgctatgctccatacgaaaaaccattcttgagaaatcaaggatggtttttttatgtatatatttcttacagctctgtttgttctttgttttttcttaagcctaatatctttatgatgcggtacgtaatcacagagacataagctgtgatgagaatgattgtgtaagacacaggaaaatcgctcgtcattccgtgataaatgaaatagatgaacagcactgacagcatgattacttgaaacagttcctttttcactttactctcctctcatgatcgtgatttggtcgattatatcacaaatgatgtcattttttgttagctatcagcaaggggaaaatctattcacctgctgatagccctttttgaatgatcactttttcagcaactgttccattttgctcttcgtctttggaccataaatcccgtctgccgctagtctattcatgagctggaaccgcttgaccgcattcgctgtttttggtccataatagccatcaactccgttgttttttgcccctttgtctgggtaaaaatagagggaagataaggctttttgcacagctgtgacttgtgctccctttgttaggggcttggttatttttaagatgccagatggcagatttgacgatttctgtttggaaactggtgctttgtgactcaagctctctgttcgaactggctttcttgtccttttgctgacggtatgggctgtggctattccagctttaaattgatcccaccgtccgagcaatttccttggacattctttcccgctccaatgtttatgaggcactacatttgataaaggaatccgcaaatcgcccattagctttcgaatgagccattgggcgttttcgactgcttgttcaaagttgccgtctgtattttcgcaaatttcaattccgattgatttcatattgccattgcctcttccatcgcctgcatgccagccattctcggttaacggtaaatgctgataaatgacctgatcatcgacagtgtaatgccagctgaccccagtacttgaacgcgcaacaaacgcagcgtgactccccgcatttgcaccttttgccgtgttagaggtattatgcaccgtaatatagagcggcttcatcgtatttcctggtctgttgcggttgtgttttggaatataggcttgaatgatattgaccatattgtttctccttcaacgattatttggttagccctctttgtttcagtgtatctttttgtaattgacctttgtaggtcacataattgtttttaaaccaagcgataatggctgtcaccatcgtaaaaatggtggaacctgctacatatagtgcctcaccagcggtttgtacttgctcctcactaatcggcagcaccgtctgtccaaacatgacaagcgtttgattgatgagtgcaataaaaagaagcactgttcgaatgacagtgcctttgtcgaatgttttcatgatgtttcctcctattttaaattccgttcaattttgtcgagtttgtcaatgacgacgtcatacttttcactaaactttgctaacacatcattttgcgcctcgatttgttcgttgagcttgttttctcgttcttttgttgtgttgagaacataaaacagaatccagcaaaagagaacagcaaatgggccctgtgtcattaagttttgaacgacatctacttccattggaatcaccttctttccggcaaaaaaataaagccattaggcttcgtatatttctccagttatattttgatagtcgtctgccgagatccagccaatgcttacataaaatgcaatgtcctctggtccgtaacattgccagtcccagaattgtttgatatctgctacagttggaaacatcattctgaatttccccctttctgcatagccaatagctgcgttaattgttttgataacaaagcattttgcttctttaaaagttctatatcacttggcgggagaggggctggctttaggctatttatatactcctgtgtcgcagattcataccattgttgtttttccacatcaaatgcagctttataaaaagaaggattattgggtggtgcaattgttgtgcattgatctggaatgacataattgccttcatcatccctttcgaacacttcgataggtctgaccaattcattttgatgattgtattcataggcttgtatcatttttatcacttccttaatttaatgggacgactgtgtctaaatagtagcctgttactgcactgttattcactgcatgtaaaccggttagttttaactctcctgtcttatatatatataatttactatgtcccgttgtacctgatactggaactgatacaaccattcctttatctggtaaatttagcaagcccgtgataggaatctttccacagatcacttctctatttgctattaggtgacctctcaacaataataaatttccccatttagcatattgaactggtctgtctccaatagaggaaccattgtctaatgtaacatttagccactgaacattttcaaaatcagcatcagtgactattcttttccaccctttaaagacaccatcagtatgaacagtaccaaaccaatgagtgttgtcataacttctaatgacatgaatgctctttctaccatttacagtttctatgatatcgatattaaaccaagaagaatcattatcgacaggcatatttaaaacattagaccctacagcaaagtaaaatcctgatggtaacgttaaaatatcagttcctattgacattgaaagtcttagtccctttgaatttaatagattatggtcattaaggcgtttccaaccgctccattcttgttgtgtacctgttacatcagttgttgaacggttaatatagacatctcctgtattgtttgcaccaatgacccatccataggtattttcactaaagacagacaaagccctcatggaacttcttgtcggaagatctggatgtgcttcatgaatgtaccatgagtgaacccccggcaattttatcagcttatctaaaatactaggatcatctgcattaattctttcatatgcttttccatcgtcagctgtgattttagacaattgtcctgcatcccatttgtttttttcattttgtgttggcatttgcacccagttgatcgcaatatcttttacataataagaaaaacaaaatgtatttcctaatgtgtcaattgcaattcctacaccaatattgttttgtccgacaagctggaagccccttaatgcagctttacctatagcaggagaatcgactactccaacaccacctggggcatagaatgagcaggcacctagacctttaatttcctcataaatactgccacctggaggaatactgaccaaatgcgatccattatcatttgtcagtttatatagctgagattcattccacttcttcttttctgaatcagatacgtgaggaattgtatcttctgcatgatggtgaatttgagctaacaattctgtatcattttcaatcaagatctgcatcatctgattaaataaatctgcatgcgctttgtcattgatctcaaaagaacgcggtgtttttaaaaccataattctcccccttatatatgaatgattagaaccaaaaaactcagtaaatttttaaagtgtttttaacccttttatatcacgtaatatctgtgccatttgtttagttaaaaaggcattttgctcctttaatatttctagatcattcggttttggttttgtttttaagctgttgatatactcctgtgtagcggtttcctcccatttgtgttttacagggtcaaatttggcaatatacgattccataggagggggtacatcggtaaaaccttcaggcattttctcatgttcattcatgagtttttcttcaccaggcatataaatgaattgatcattatatttataaatccacattttagttcctcctataatgtactaaatttgattaaaaacgtaatgaattctgtagggttgactgagttagaggacaattgtacacatacccttccgtcattcgaaataaatgtccggtgatattgtggcaccccagatgtaccaagactagaagcaacgcccacataataaacagaatgtttcggacggtatccctctggaaggacaaaaacaggaatttcacctaatgctccatctcttacagcgccatttatctccacttctcctaaagcatttttaccgaaacgaatgggtagcgcgcttgaactatattgtttccaaccgtttaaaagtctaggtgtggtccatgtcatttgtttatcggcctcactaagattacgcctccatccttgccagcctaaatttagatcgagataattcgtaaacatgttattcttattatctactgcaattacccagccataggttcctttgttattactatcagatgaagtaaaatgataaaaacctcttgcagatgattcagagggattatcttgtaccccagcgattgaatagaatgtgccaaatgttttccctgtttcggatattttatctagaagactttcagcagcttctacagatactcgaactcccccagtatcgtttgtaattttaatcaactgactgtcattccatttatttaaatcttctatactcggaagaggtgtccaagtaatagtcgtatgaccaaaattgtagtaaaagctgtatgcttttcctgatatatctaccgcaaagcctgccccaatattatcttgacctactatttgcatgcctctgagtgatatatttgacgatgatggagaatcttcgactccaggcgctgcgtaaaaggtacatgtacctttatccttaattgcatcaaatatttttgaatcagctgagacattgataagctgcataccgttatcggcagttattttatacatctgcgaatcattccattttttcttttcttcttcagatgcatgtgagttcatatcttgtgtatggttggtgagctgttctaacagaccattgtcgtttttaagcaaggtttgaaccatttgattaaataaatcagcatgagctttatcagtcgtttcaaatgttttcggcttatttatatccatttaaaaattcccccttaataaatatcatcaatctcaaaaacaaattcgatgtcgccgtctttttgtttgtctgtcatggtgcggatggcggtgaatttgccggcttcgtcgacaagtgctagttcgttgatgacttcacctgcaagttctccttcggcgatcgtgcaggtgtagcggatttttgctggttccatgaaggtaaacgaatcaatctctttttggacgagttcttttttgagtttttgttcagtgccgtctagtgaaatcggtttgccatccttcgttccgccatttccaaatgccattttaacgacttttgtgagttttgttccttctgctcttgactttgccatttgttgacgtgcatataatgttgttacggttaattgatcagccattgtgatcctccttatagctctattttttgagaagtagctgctagcatttttgatccgtccagcggaacagatccatcgagaatccagtaatgatccttaatcagtaagctgccgccctgttcagtttggacatgtactggcaatcggaacgtcattttctttttggtttgatgtgacagctggctttttgtgcgtaatgtcagtgccgctttttgccttgtttcatgtaccgctccagtcatgacataattcattcggtatgtgttctctgacttatgctgaaggggcattctcaacttcaacgaatgccggaaacgagccggaacctctgttgtccctcgtgttccgctcagataaaacgtaccatttaatacaaattcaccattgagtaaaatcgggatatgatcgaaaaaacccactctgcttcgcagtgtgagcctcccgtgatgatcatttttttcatgtacatcagtatgatgaaatgcagtgaatgtataagccaaatgagctggctttaacgtttcaagtatttctacaatatatctagtgttttgcagatcatctaggttcacacgtaaggcgaaatgatagcgattggtggtcagacggatgatggcacttggatttttgagaaagcgattcaccgatttctctaaagaaagatacgtgatcggtggaatgtttgacatcatattgagtaagcgtgctctgcgaagttcaatagagtcatccgattctcgctgcgccttcagcattctttcccatctattcaatccccatgttgctgtcaaagggaagaactgatccgttaaatcgaaaatggattcatccaattgctcaaactctggcgcttctgttttgagcaggtgatcgacttcataaatctctgtaaaatatggcggcaagtagtctttcatttcatcctgtttgctcaataaccttcacctgcctcagacgcggtatctcaatgtcctgtaacactaagttttttgactctccattcaataacacgtttgcataatctgatacactttctgaatggtacagaatgtcatttaatgcggacattcgaatggtactcttttcaaatgcgattgatttcaacagcgctttgaccttttcttctatttctttctgcgctccttcaagggtccagtccatttgaagttcgacggatacttctatatcaatatccagccatttggcgctttcgacagtcgcttttgaaccgataggcgcttgtccttctccttcgcctggtactgggtcgatgtattcctgtactcttttaacaagaagatctgatgcaacatctagattgccgtctgtgatgacaattttgactgttccttctccattccaaagcgggaataccttcgctctgccaactcctgtcacttcctcagcccattttttataatgcgccttgttggcactgacagcctcccgcctagcacgtattaagtaacgatcgtataacgaagcgtcatcttcttcctcttgtccgggtatcaccaaatctttcatgataattgactctagccccgggattgtatcaagtgaaagcaacggctgatctgttaattgaccattgccgatcttgccaggtgtctcgcattctagcgtgccatcaatcgaatattggaaatagacgtcttcaataaaaaaacgtgagccagctggaatgttgatatcgttaggctgaatagctacggaccaaaccgctttagtcgctggttttctttcaattcctacttcagcggcccgccgatctagaaactctccttgtgctgtatctgcaaagaccagctcgaatacttgatcaagccaaatataggactgggccaattcagcggcagcaggtgccaaggcattccaaatgacactgttttctcttttatctatgtcatccggcagtctgtctagcattctttccattaatgcttcgtacgtttgttcctcaaacatcgctctccatcacctcctctatttctaatgtgccttcatctgtgacaatagctagcttgacatgaaacgagtcattttcctttgtgacctctatctcttcaatatgatcaatccgttcgtcgacaattaatgcttcctctagcagcctcggaatctccatttctttgtattcatccgtggcttctgtatccgttaaaagctcctgaatttcagtgccaatgtcgtggctgtagataggatgtgcataccgctctgtcctaagtgtcatataaacgaattgacgaattgcttcaatgcctgaaattgtttcacctgtcaatctgccagtttcgacatctattcgatatgtcgtcgaggtttccacctcttcgtcttcttctgtttcctcaatttcttcctctggtgaaagtgccacgttcatcacctcccttacaatttgtcgatgatgtagaaggattgccctcctgccattgccagcaccataatgctgtcaccccttttcagttcatcttcctcaccattatttaggcgctttggccaaatcagtaattcttccggaatgatcagtttatggttttcatttaaccggatgcttacaggagaaactgccgtgacttctccaaccaccagatcaattggagaggcagcgtctacagcattcactgctaatcgtttaatcgcttcacttaacctcacgcttgatcaccctttggaatggagtttttctcaacgacatcaattgtcatggtgtgtttcacgccactaaattcatgtttgtcttgatcgatccagtacgtttttttcacgtcgatttcagggattttcaaatagattggaagaccgctttgcagatcaggaatgcctagcgcttggatgcttttgacctcttgtttcacaccttttttctctgccagccgtactttggctcttttttgcagctgcggctggttaatttgccctgtaaccgtctcaacatgctgtaaaatgccgtatttactctgacctgctttatcctgttcgatcactacaatctctgatttgctgccttttttcttatttttcccctgttcatctgcagacgtgcgcagcttgacacgagtggctgtttcttcaatcgaggtgctgtactgatagccaatgagattgacacctgattcaatgacccatacgtcctctggatctggccaagctctcagccccatctttcctttagtagaatagatttgatagtttctgcccgtttgccgctttgtttcttttaatgctttcagaatcatgtcatataggctagtatcatttttaaacactagtgatttgatgacatgacctgtattggcgatagaggtcattgggatttgaaagtcagccccaatccgtctcaagatttgatctgctctttgttttgaaaaaacatagacatcttggtttttcaccaaatattgaagcatgtcgtatgcggtaaaggtcagtttcccttcaacaggcgtccgagaaaacacaatgcctctgaacaactcttttcctttccatttaaaaagaaccgtgtccccttctgagacacggtaatatgtttgactgccttgcttagtgataatatttgcttgaatagagcgaggggcttgatacctttgcccctgaagtgtcacactctctgtgacaagctcatacatggtgccgcttctgatggcaaaaagctcgatcaatgccagcccccctattgtggtatttttaacctttgtccagggaaaatccaatgccccggctgcttaatattgcgtttgctccgtttaatcatcgctaatttgttggcattccaaatacgccgccattttgtactgtcgccataaaaccttcctgatatggcccatagcgtatccccttttttgacggtgtacatttttggtggtgtttttgaaggccgtttctttttcgtttgttttgcttttttctttcgtttgattttcctaggcgatgcggttttgtattcctttaactcgatcgtaaattcacgatcgccaatatcatatgacccttctttatgggtgaagctttcaatgctgcacgtcatattgatttttgtccccgttacaatcagccgcacagacttctttgaacgcatcattcgttctattttcgctatcgcattctccggtgatggaatgcttttatattcagcaattggcgaatatttcttaggaaataatgaagtgaatgatacttgcttagccgatgggacatcaataaaggttagttctccaaaagaggcaacctttaccgtttcattttgtacgttatttgtgatttcaagttcggatggaaggacagggaatcgcaacttgtcctttccttgggaaatccacaattgatacactgatttacccatcaatcacgacccccttcgttcctgtatgaagctctacttccagttcatctacgagcatttgtctaattttttcgacaagcgattgctgatcttgtccattatggaaatgctggtctccattgaattgaatcgtgatttgtttattacctggcgatgcagtatgactagcagactgagctgaggtgacttgttgcatctgtgattctggtaaaggagcagatgcatttgttggatcatatacttgcatcccaagtgccttggctgcctgcgttaataaataccttccgcgaatgcctctttcttcaggtatgatccattcgcgtttgtttccttcaccgactctagcaacctgctcctgagtaatcagtccgccatttgcgtagcccttataaggcccgcctcttctcatacttcgtaatcccggtgtattgaagactgttccatatctgcccttaatgtagttaatggctgctacggcattatgaattgggttccaaatgtcattcatgcctttgcctttattggagttaaacgttggtccaatggtttgcattaagcctttagaaggcgttcccttcttggcgtttgaatcccataagttgattgctctcggatttccacgcgactcattctgtgcgatggtcatcaaacctgggagccagctcattgatgtaccagttgccatgatagccgccatgagccattgttttatattaagccctgaagcacccataccgctgaaagcgccaattaatgaaccagcctgattttcagcaaattttttcacatccactgagtcgagtcctttgacgacaccaatcgatgcgaatttcccaagactcatcatcacgcgtgaaggggaatgaatgtctaattcctctctaaacgcctgctctactttcttcgccatttctttggcagcttgtgtgacttcacttgcttttgaacgcatgccgttgttaaaggcatcgatcattcctgagccccagcccggtgattcttgttttgcttgtagaaatggttgtttgatgtgctgatctacgtattggctagtaccaactgatgtggcattttgacctgtggaaaaaccactaaccgttccagaaccccaagttggtgatgctgtcatcacttgttggtatggtgcttttacacgactttgcaaaaagctgtctgttcctgttggtgtcacctgctgaccattcgcaaaagcagcaactgtctgctgaccatacttacctgagtctgaggtcaattgaccaaaaggctgctgaatattcttttgtttccattgatcaagtgtaatcactttttgatttaatccttgttcaaaatccttattaaattgctcgcctatgctggaggcttgaatgtttccagtcatcgaaaccgatccgtctattgaaccgacagaagatgatgaagctactgctgtaggagctggagagcttgatacttgatttccagctgctccgcttggcataacagacattccaagatgagaagcagcctgagcaagcagcatcttcccgcgtcctcggttattttgagttggaatgacaaattcgttacctgcttcaccgacccatgatagggttggttgggtgatatagccgcctgtggcattgttatcgggttttttcttcccaacaatccaattgatgactacatctacaataccgcctgctttgtcaaaaatctttttaacccaaccaaacgctgcagaaaacccatcaccaatagcttctgctacttttacaatcggcttttgaatgttgtcctcaaaccatttggataatccatcccatatatctgtcaccaatttatacgcttcttcaaactttttaccgaaactgtctttaatggttcctaccgtatctacaagtggattccacacattttccataaaccatgtcgatacagctccaaagattaattgtatctttttccatgcatttgataatgctgtccaaatccctgtagcgactgtagcaactgtactgctcagtggtgtccaaacgttttcaataaaccaacccgctactgcactgaacgtttcttgaatccatgtccatgcattgactaagcttgaccagatggtcgttgctaccgtaacgactgtgtcgctgagcggtgtccaaacgttttcgataaaccagcctgctactgcactaaatgtttcttgaatccatgtccatgcattgactagacttgtccatatggtcgttgctaccgtaacgactgtgtcgctaagaggtgtccatacattttcaataaaccagcccgctactgcactgaaggtttcttggatccatgtccatgcattgactaaacttgaccaaatggatgccgctactgtgacaaccgtactgcttaatggcgtccatacattttctgtaaaccaagccgcgactgttgaccaaacttcgacaatttgatttttgatttcaatggctttttggccaatcttttcaaatccgccgccatcaaaccattttccaattgtttcaccgatagattctccgcccatacttcccgcgatgccgcctactagaccgccaatggctgtacctatccctgggactacgcttccaatagctgcacctgctgcagcacctgccattccgccggcgatgccgcctccagtcgtaccaatcttttcaccagcattatctttgttcataccgattagatttgttgcactaagtacacttcctagaataggcactttctttaataacttgccgctccctttccctatacttttcatcgctttccctaatccacttaaccccttgctacctttcactaaacccgtaagtcctccagctgaagctgcgatacccgcacctttctttagtccattagggattttcccaaataatttacctgcattagttttcaacttccctaatctacttggaggtcttctattcatttcggcccttgatgtagcatttggatttcttgtctgtcttggtgagcgaccatttcgatttttagttttcgtagatcctcccctgcttaaacctcttgcacaacaggggcaacaactattgcgaaacaagccttttccacctcgtgactgaggtttcgttttgggagctggatttgaaggtgttgatgttggcgctgttgttggcgctgttgttggtgctgttgttggtgctgttgttggtgctgttgttggtgctgttgttggtgcctgagtggtactttcacttgattgatcacttgcacctaagaaccgatctaatacattagtcaccaattgatccagttttttttcaggattaaatttaattttctctttaattcttccgatcacatcttgcttgtactcttctattttattttcaacccaaggaagtgccttttcatcccaaaactttctaggactcaatttttccttcactttatctgcaacgtcacctgcatatttttgaatttcacttaatcccttattggcaaggttctggatccagctctgtttaggatcttccgttttcactgacggactaacagcctcaggttctttttttatgttttgttctttcacaactgactctgcttgatctcgttttttcaacttactctttgcattgtcttgaacagacactctgatttcgtgtttagacatcgtcaaacttttgagtgtctttttgattcgttgaattgcagcggtggcttggtcaaccatgtttaatctcatatagtacgttctgttcatgagctgatagatagatttttttacctctgacattttacctgacaattgatcgtttagtttaaacgtcagcataatggggtttgttcccgcttgctttaaacgatttaaactggatttcatgacatctagccccttcgcttgaatggatatgaccaagtgatttgggagcatatttaactgattgtttaacgctttaagatcacgaaagattccttgatccagtctcatggaaatcactgacattttccgaagcgataaactgaagttttttaatttcttgtcatctaaatccaggtttattttcaccggttttctaaatggtttgagctgcttctcaaatgtttgaaatcgcttttgtattcgcagcagcttcttcgatactttgtcttctaattcaaatcgtgcagtgagtttcgccaattatttccctcctttctttgcttctttttctagcatgtctagcttgtagctgatgagtccgaataggagtgctttgaacggtcttggtgattcgtataaatctaggagttcagatggggagtagtgaagctcgtgcatggcgtaatataaaaacacggcttctttatccccatcttttattagttttttgctgcttcttctaaatcttcaatttcgtcttcaaatccgttgatttcaatggccttgtttaaccagtttgcgtattcaccgccgacagataatacacgttttgcgacttcaactggatcttgtgtgctgtaggcttctcttagttccttcgagcggaaatctggataaatagtcgattcaatggcaatacgtgcgtagaagcgctggctgtctaagtctttcacacggcctcttcctttgacatttttgaaggtcgtgttttctttttccagttcatcaatgcgttcagttgtaatggctttaaagacaaaaggaatgacattcccttttttatcaacaaaacgcttagagattggcactttgacctcttccgcttctactgtttgtcctggcataaaaaatgaaagatcaaatgtttgtttttcgctcatgtttaaaaactccctttgttatgtttttttaaatgcaaaaaagcacatccatttttgaatgtgctttccaatcttttcatgtataatttaaattgtacaattgaacggctagctcaagggtgtctggctcatcccccgataggaagggggtgatgctcatgtcaacatttcaagcactaatgttaatgcttgctttcgggtcatttattataaccctgttgacgtatatagacaaaaaatagactcccccttgagctttggtaggtaaaagggaagtctatcctaaagtatcctattcgattagccagccccttgagggccaaattgtacattgccgggatgttgacgcatcctggcttctttttattttatgcaaagtactttgcatgtaaacatatttctaagaaactttttggggttacacagtaactcttttgtagctaccctgtaactatgaaaaattataccatatcgttgaataaaataaaaacaacatatattttcgtcacttgtctgccttttgttcattaaaaggaattcttcagcttttcaggaagatcaaagtcctcgaacgtaaacggcacttcttcttcaagtgcttctgaatcgacatccagtccagcaattttagctgaatcgaagttgacatcaaataatgttacacgctcagtacctcggcctgatgatttatcgtcaatcaccgcttgaagagtgaaataaggatcttccccttttctcacatagttgagcattaattgaacgaaacgagatgtaactttatagaatgtggccgttcctgttccatttgctcctgttgttttatgaccagtcattcggcggcccatcacgttgacttctgatttgtttttctccacgtttgcttcaaacgttttgataaaagcaagctcctcaccttctaagaaaagacgaccctctttacctgaaattgtattttgcgctttaaaagccatcttacttcacctccacattgaaatagaatttttctgctgcatctactggttgaacagctagatcgatgataaaaccatcacgatcttcattgagaccgatgacaatatctgtttctgagttaaagcctgtaatgccgctgccatcttgaagctgtgtgagatactgtgtaatcagtgttttcacaagctgtactccatcatcagatgctggaatgtcattgccattggctttgcgtaatttaatcagattttttaattcaaacgttaaatcattgttgatggcatcaagcacacgaatgattttatttttcgccatttgctgattcttttcagctgtgaaacttgttaaagagttaatatctttttcaacactcaccgtgcggtctctcgcatcaaaggtgaagaggaactccccttgggataatcggtattctacttgatcattatcaaggcgttctaatgtatctactgctccttcgtattcaacaaaggtgagtgactgattgaagtttgcacctgcacttgctcctgcaacccaagctgttgtttgagcaggtgttagttctgttccatcttccagcacaacaccacttgtcacattgataatgccttcttggtcagctgcatagttcgccacaacgccttgcaccttacgtccttgcttatcacgtagacgctcgataaatgaagcgaaggttgcttttaattgctcactattatcgactgggagcgcaatgacatcaaagtattctgtttctgctgcttctaggaaagctgtataatctgcgacacttgccacaccgttttttccgccgcttagtgctacaccagctgtgataactgcttcaccttcaccagaaaattgaacatatttgtttttcacaagatctttgacatccgtcacaatctgcttatccacaatatctgttccaagataagtaatgacgtcacgttttgtgctgtcgagtacattttctgccacttggatggtgatctcatttccctttagaccgccataattggctgtgaccacaaagttttctgagatttcagctttggctggctccccttcgtttagacggtaaagcaagaccgtttgcgcttttttctttgcttcacggaaaagaagaagcgacttgtcatcaatattgagtccaacctttttatttaagtcttccatattggaaacggaaataaagttttttggttctccccagctcatcacaagaggaagtgccaccgtacctcgatcacctaaagtaattcgctgctctgctgttgttttaaaattaaagtaaatgccaggacgctttttctctgtacctggtgtaaatgtgcctccgttcatcctttaaacctccttggacaaaaaagcatcaatgtgctttttcgcttctgtttttgtaattggttgatgtttgatataaaaaagagcaccttcaaggatttctggtttaaccccaaaaagatccttactgtgctcctttaaggcttcaaatgaaaagccaaattctttttcttcgccagctgtttgggcaggcgctgcttttttagtcttgctcacgtttgatcaccccatctgaaaaattgatgtcttcaaggctcggttgtttgtctcggttgtaccaataactgctatcccacgtcaggacaatcgctgctacgccttgatctaacattctggtttccactctttttatgcggacataatcatcaagcacctctccatcttcactcatcatctgaatcatttgacgatcagcaagcaatgcatcaacaatgatttctgccgcgtcatgcgctttttctgaatttatatgaaacactttcacttgcagcgaataagatttcataaacgtagataccgtatctggaccgctgatcactgttacgggcggcacataaacagatggtacttgaaaatgctctggcaaaagtcgatcatacattgttacaggaaagtgtgtgtaaatataatgcatgattgccccgacttcttgattcatttcatcacctcccaaaatgtcgatcgaaccagctttgaagctttcgatccagcgactgctcaaacatttgctcatagagcatgacagcatgatcccagtagccatttccatctatccattgagaagcaagcatcattcctgtctttgtattcggatcatattcaaaacggctgccagcccacctgccaggcacccatcttcgctctccacttgaagaagtagcatgtccatcattgacataggaggcatactcaagctgggttcccacttccagcgtgagaccaccttttgacatgagaaagtgattctccttgtctccttgcgtaaaggagcttagaagccggcctgtatcgacagcattctgcttgattagctcatcctgaatgatgtccaaaagctctaaacccatgtcctctagccaatcttgatattctgcttttaagccgccggcacacgctgtttccagctgtgaaagcagccggtcaagtccatcaattttcatagattttccttcctgactgccatcacttcaatgtgatgatttttcactattttgggctgctgcaatttaagtgagacgccgttccacaccattttgtcatgcaggcgaatatcactcgctaagggaaaatggacaagataggactgataaatcactgtattcggctcttcttgcacaagtgactgattcttttctatgacataacaagccagatctgtcaggctaggcgcatcaggataggaaagagtcatttgtaagtcatcagctggaatcccgaattttcctcgggaagcctcctgatgttcaaggtgaaaaagatcacagcggtctgttaagagagattgataactcataatgatctcacctttaatttggtactgccacgagttaatgatggttcaatgtaatcgacaagcagggcatatacgtaaggtttgcctgtcacttgatcagctgccttcgcatatgaataatcacccattttctctgacgtaaagcctttcatcatagattcatcatcattcagcatggcaaaatattgggccatttttaataaagcgattcttgctttttcagggaggggctgatattttccgcttgagaaatcatgacctacgatctgaaataccgcagcttctgcttcgataatatctgctgtcagtctttctacagctcgatttttcacacgctcaaatacagaataggcttgcagttcttcaggagaaataatcatggcctgccgtcacctactctttcactttcattacttttgctacagcatcctcttcctcaaatttgctgtctagcttcgctgtcagaacaataataaatttccggctgcgaatatctttttctacttcaattcgaatatgacgagaaaaacctacgataatatttttagggtgcgtcagcaaaatatctgatacgtctgttcccgcttcgtcatatgcctgcatattggcaaggcctttgaccggcacaccgaatgcagaagaaagtccgccttgaatcaccgcatctccgagagctgtctgacggtttgctacttgatccttccactccacctctaaacttggggatgtgtagaaacggaaattctgaggtacacgtaaatattttgacggcatcgctttataggcttgtttcaacatttggcggctaatttccgctccatttgcatccacaatatgagatactgcttgttttctcacgccatccatttgggctaaaaacgggtctgttgaagtcgtatccccattgacgatgagctcttcaatatcaactgccgctcgttcagccagcatttgcataattgtctgctgaattccgtctttttcaatattgttttcaatgctgtcgtaggtcatatgaatttctgcaatgacctcttttgcattgagctggacagtgcttgtcgctgggacaacacggtctttcgcatcaagcgcttggccttcttctgctggacgcaaaatacgctggccaaaaccgattttttcgattttttgtgaatcactttccatcggaatgatgcgtgcatcatttaaaacggttggtgtgttttgcatcattctaatgaatgtgttggattgggttgcgttcatgagaccgccggtttttaagctggcaagtgtcatttcagccttgcgaatcaactcttgatttctcacactgtttcctccttatttcggcttatagtaagccatcccatatgggttttgtcgtgttgttttgtgtatcgtggattgtttgttttgatatgccccttgccttttcgagcatgtgaatccgctctgaaataggcaaaagctgctgctcaagcacttcctgcatcgctgctttttctctgctggctgatttctctaaggaagagagctgatgacgaatcggtgcaacgacttgttcgagcactttttggacaggttcttcccctgtttgttctgtttcctgttgttcagcctgctgtaagacgttttcaatggccttttttgctttttcaagctctcgcacttgatccgtcgtcaaagcggcctcttctttttgtacgtcttctggcctttcaccaatcgtttgaagtacatcctctgtcttcaggatgtcctgcacgattggaataagctgttctaaggccgctcttacatccgcctcatcaccatcacttgactgtaaggtttccagcagatggtctaaaacgttccaaaatggttgtgacatgtttgcaccttcctcttttaaaaagaaatttttcagcaaagaaaaaagccctctctcatttgtgtcttgagatagaagctgatcttgttcttctatggcgacgatgtccgccgttccagccattgaatagcctgtaatgtggcctttttgaatttgatcccaaatctcttgggaagcctttgtcacaagcacccaagatcctttgcgaatcagctccccgcccacttcaacatcagccggagcaatatatgattcaaccacttcgccaacaccatcctgaaaatcatgctgcttgtcaatataacgtgcatccttcataaagccgtgtgctgctctttcaatttccttggctgtcataaagtcttgatgtgcatcaggcgtattcggctcatacacgacaccgtacacgaggcgatgagcatcttctgcctttgtcaggacactgacctccttttgaaagtcaggccgctttttctttgctttcatcaaaaagaatttcttcttgttcgctgctttgtccacgtaggaaacatgcgtaattttagcgttttttagttctcttggcatatgttcaccccctttcaaaaaagcgcacccgcttctgtttatttcgtcagctggtccggctctggttgaggcttttcttcagctgatttcatgcggctttctaaaggtcggtgatacagttcctcaggccattcctctagcgttttcccaagaattcttcctgctagatcgcgcaaatcgttaggtgacactgcccccgcctgaataaatggcgtcagtaccttcgcaatctctaatgggtctctaaaatcaggaccatttaatagaaaacggacatgccacatatcaagatccggcaggaaaaaagtattaagttttcctgtgatgagatgccgttctggctgaaatacctgctcttctgttgttttacgcgctgtatctgccgtcgctttgttatagtcttgagactcacctgtgtaaattggcggcagacgaaacgcagaacggattttgtttcttgttttttcatcgtattctaaaaagagcgcatcttcttgcaggatctcggctagagatttgaagtttactttgacatttgagacatcttcttctcccgttaaccctttttctgtcggcagaccttcaacttcaagcaatagaaatttatgcgcgtgatcagatccttcaatatcatccatatagtcttgaagctgctgataagaggattctgacagcatgccattttcgacaatgatggcacctggtacatgccgcccttgtttaaaataaagatagttcagttcctctgccttgcgtgctccgtacatattgacgatgttgccaatccagcggggaatcccatacgttccactgccaattttgaaatgaatcacttctgttgcgcgaagcggctctggtgtggtgtcatcgtacttgcctgtttcacagttcaaaatgcgcggatcaccatactccttaaagaagactttcttttcgttgatcacctgcacatatttgcggaatcttttctttcgattcattgtctttaattcgccattttctgtgtagctgaattcgacgtcgactggctcactaagcttgcaaatgcggatatgaagcgcatctaaatactcgattcctgccggctttccttgtccatctctcagtacctctaaaaaaccattgcccgttttctctcggtcttccaggacatagccaagaatcacatcagcggactcatcatagttcatgtacttcgtaaactcttcaagtcttgtccattccttttctgcggctttcttttttgccggttttacaccttctgcattaaagtcaaaggcgtattccaccccaaatccaaagcctaaaatattcgttttgtacgcatcaatacattgctgaagaatggttgaatattctgccatgctttttaattcattgatgttgtatggcgggggaacaatgtcatctttttcataggaaaattcatctgcatacatttgttttgtatgatcagacacgtttgccttcataatcgttgctttcaattgtttcattgtacggacctcctctctctgtttggacggacacgctctgaggcggtctgtttcaaatccgtcacttcatagtcatccagcgcataccagatggctgataatgtgtgtgggtcgatttgaaatgcatcttcctctaaacgtccatccttatctgccttataggtcagtgattgaagttcatagattgtgtacggacaagcatcagagcaaatgattttcttaaaccgtttgatcttttttgtatactgcaaacgcgagccttggaacttatgtgctgccaccatttgaaatccacgctgccgaaaatagtgaatggttttaggctctgctgcatcggctttgatgagttcctttgattcaatgaactcttttaggtcaacagctgtttcatcatctgttttcccgcgatcgtaatattcccagtaaatatataagtactttttttcatggtcgacggctaatcgaatgagcgcattgtatgattcaacaaatccaaaatccatgcctgctcgttttagcggccggtccatctgctgaatcgcttctaatacatcagcatgatttcttacctcaaattgaggaaaaacctttgttccattgatgccaaaatagcccttcctcgctattcgatagaggtctgggtcgtattctttcagctcatccagctgcttcacatagcttttagggagaaataggttatcttccgctgtggagtgatgatagtacgtatccttgatcacaacggtgcgttttttgtataaggtttcgtcatctaggacaaatcgcttcagctgttcatctcgaaaaaaatgtctgtacgtccaattatcttgaccaacaggattggtcgataacatcatataaagcggtaaagacgggtgcctcagccttccaagcagctctttaaagccttcataagaaacctctgaacactcctcaatccaaataatcgagatgttgttaatcgattttaatttctcaggcttgtccagccctttgaataagatgctgctgccatttcgaaacgtcaaggcaagcggcgaactgcggcacttcaccacatgatcgatgccaagatcgctgacgatctcttgtaatagagaaaaggttgattcgcggtgcgtatcatagacttctcgaatgacaagtgctgtccgtttttcttccagcagctttaaaatgagttttaatgcaatgtgatagcttttagaggagccgtaaccgcctactaaaaattgaaacttctgattccaatcgaatagaaaatgttcaaagtgaggattgacttctttttcaatcaatggcgtcatgagttatcctcttttcgcttgatcatgatgtgaagatcttcctctttttcttcgcgcactgctttttttgttttttcgatggtcagttcaatttgctttagtcttaatcttcgttcatccttcgcatgtgcaagctcttcaaactgtttaatgagacgcctgagctctcccattgcacgagattgggcatttaaaaaggtagcatgccgatcccatgaaaattgaaacgaatattcttctgtgctgatttcttgttctgactgaatgccttctactgtttcttctaatgaagaaggcatgtatgccgcctttttcagctctttgatcatgtcatcttgatctgacacatacatgattcgctgcgcccgaataatggcagcatattgaatttgaatttgatcccagattaaatcaagggatgtacgcccgcccattttctccatgatttcaattgtttcatctgaaagaaactgattgaagattgagtgtgcctgctttgacgaacctttttgcctttgccatccgtatcgtcttttccatgatttcacggtatggattgagacattgtaatgatcagcaatttgctggtacgtcatccctttcatataatcttgcttggctcctatccgtttatctttcatttacattcacctgccgcctccttttaattcgaacgatttcctgtgaaggaatcatttgtgtagggatagcaaacatccgtttggtctttctaactataggtggcaactgtaagacaagtgctgctccatttattttgtaaaagaaaaaacgcctattcagctgcttcgaataggcgttcttgtacttttttggacatctttgtccgagctctctccatatgtttttggacagttccttttttcacatccagcataatcgcaatctcgctaaacgataatccttgcgttgtgtgcatgaagaatacgtccttttctcggtccgttaaaacggacaaggcttcatcaattcgtttcttgtcccgctcactgaattctctttcattttcttggataagtgtatattcatgtgataaagcctctaacacttctggatttgccaggatggtacgctgatagactgaacgtctgtctaatcctctgcgtgcgcctggctgcctgccaatttgaagccattccacgacatattcgagatcgctgaccatactagcgataatttttttatcatgcttctcttgatctgacagctgtttgtcttctttttctctaaatggttcatatctttttctagcatcctttaaagctcgtttgtattcgatgagtaaatcttgcatgctggctctctcccttttttaagaaaataaaaaacggacaccaatcagtccccttttcataaggtcttgatcagtgtccgcaggctttccgtcttggacttatgatgttgtgatctatccagtaatctagctgattttaaaaccaatctcgtgatctactcttgcaaaatgaccttttgccgtttgtataatggtttttccatgttcaggtacatctatctgataagccgttcctacattcccatctaacacgatgacttggatttttcctgtttccatctcaccgacaaatgtctggttttcttgaatgaataattgttttggctcgttcatatacttgtctccttaattggtgaggacttcgtgccatcacctatcgtatttaaaatgatttcaattcttggacgcatactataaaactgggaaactcttaaatcaacgatctgtagaggagctctatccgcaatagaatgaagtgcttcttgaatatggtgcagccgcggctgaaagatgctgacgttcactgggcgtatcaaacctttttctgcgtatgtacgcttgatttgacagtcagctatgtcaagcggcatgtcgtcaaataaacgaatctcgagtgatagtgcgtcttttattttctgcgggcattgcgcttttgcagctgctcgtattctttttatcaatgtatcttttgtgaacaataactctgtctcaatgatgaaatggatgaccatgttatgagctcccgtcatccttttcccactgacgaatgtcttgttcgtttttactcgcttttagcaagcatttgaggatttccatgattttcttccatcgtttcatgtcgtcttgcttcctccttttttgcttcagcgagcttttccgccaagagggtcatgtatgtttgcttgtcttctgatgtggaaaaaacaaacaccggtttctggtgatgaaaggtcatccagccaccggcttggactaaacaaagctgcgcttcctttctggcatcaaacgtcatctgatgtttcatctgcttcaaatccctccagactctcctcaatctctgcttgatacccataacgtgtcatgtcatatgaccagaagctttttggatatccaaagtcatttatctgcgctaccattggatgttcaatattcattttgttcgtctccccttttcaaataaatgctcttcctttaaagaattactcattttgtgtaacttttgatcaaaaaaaagctcttgaacacccctatttagcaaatccgcaatatgctttgctatttctaagctgggcttcgttctgcccatttctatatttgcatagccgctcgtgtacttatatcctaactttttcgccatataggtttgtgttttcccttgtaaaatgcgttcttctcgtaaattttcaagcttcatctttccacctcttactcaatatgtgtaagttatattcattatgataatatacacaaaacgagtaagtcaatcattttttattctttttgtgtaattatttatcttttccgtgtaattcatgataaaatttactcataacatgaaaaaaggtgtttccaatggataatttgactggaaagattttaactgaattaagagagaagcatggatggagcaagtctacggttgctaaaaaactcggattaaaggcgatgtccacttatgcaaattgggaatatggcttgagaaagcccgacggtgaaatgattgtgaaaatcgccgaattatatggggtctcaacggattatcttctcacaggtaaggacaaaggcggaactgatgccgaccttgcagacgatccagatttgcaaattgcgtttaaggctgcctccgatttttccgaagaagcacgaagacaaaccatcgattttattcactacattaaagaaaaagagaaacaaaagggccgtcagccaaaacagcgagacgacgattgatcatctcttttcataaagctttacattgctgggatgcacccagctttttttatgcctctttttcccctaaaaaagagagacctcataaataatatgtgacaattttcaccataaatactctttttttcatatattttaattgacatataatactattattattaatatatgtatataccaaaaaaaggagtgttaccgatgaaaaaattaatgaaagcttgtacattgtctttagctgctctaggtgctcttacgttcttccaaactgaaggtgctcatgcagctgcccagccaaaagaaccagtcatagcaaaagctcctattatgaataaagtgattacagtgaaccgcacgcttactgtaggttcgtcaatcgccgtctctcttccagcgagtcaaatttctgtgtctggtgcaacatatgccattcaattagatcaaacagctccgaacttcacttggattcgtgcggtacaacgcggatctgtcacagtttcttactataattcactaggcgagcttgtgattaactatattactgttcgataagctataaggctttacatataaaaaggcgatgatttcatgatcatcgcctttttatatgtcttcaagtatttttgtagacttcatttatccaatgcttgccaatgactatctattatgttaacttttaataaaaataagttaacataatgagaggagcttatgatgggaaaacacatatctttgtcttgggaagcgatagcagagaaagcgctgaaaaatgaacggatcacgctgcaagaaggtctagatattcttgaaactgacgatagagaattattatctatcatgcatgcagcctaccaagtacgatttcatttttttcaaaataaggtgaaattaaatatgatttttaatgcaaaaagtggttattgccctgaaaactgcggttattgttcacagtcgatcatttcaaaagcaccggttgaacgatatacaatgcttgatcaaaaaacgattgtggctggcgcgcgtgaggcgctcaagagaaaagcggggacttattgtattgtcgcgagcgggagagcaccttctcacagagaattagatgaggtgaccgcagcagtaaaagagatcactgagaccatgcctttgaaggtgtgtgcatgtcttgggttattaaatgaagaaaaagcaaagcggctgaaggaagcaggggttcatcggtacaatcacaatatcaatacacatcaagatcatcatgctcacattacgacaactcatacatatcatgaccgtttgtcgacccttgaggaggtcaaacagtcgggcatgtctccttgctcaggggttatcattggaatgggtgaaaccaaccagcaaattgttgaaatggcttttgcgctcagagccattgatgcggattccattccagtcaactttcttcatgcaatcgaaggaacaccacttgagcatcaagaacgaacacatccgatcaaagcattgaaagtgttggcactcatgaggtttgtcaatccaaccaaggaaattcgagtatctggaggcagagagttcaatttacggacgcttcagccgcttgccctttatgccgcaaattccattttcgtaggcgattatttaacaacaaaaggtcagcaggttcaaacggatcatcacatcattgaagatttaggttttgacatagaagaatgtgcgttataaaaaaagtctgccggtgaatcggcagacttttgacaataagattagaatcttttatggaaatcaacagtgccgcttccttcctcacggtcaaagctgccaacaaatgtccagttaatatagccgccgtcaccattattgacgaacgtcccatcttcaaatacccaaataccaaacgtaatcccatcatattcaacactatcatagtaaaccacattgttcagtccgctaaagtcatgatcttggcttaagttttggacaacgacgttatagttttgacctgcttcatagaaggcgctgtacgccgcattttttacgaatccatcacgattttgagatgattttactgcttgttcaattttatcggcaatggctactggatcaatcgagacacttccatcaacacctgttgtcgttgcagcttcagccgtttgaccaaaagtcgtaagagatagaggggcagcaaccattgacgtagcgatcacagaactaacaaaaaatttgcttgtttttctcattatttctaactcctcctttaattggtatgtttatgtgctaccccttctcctgtctcttaaacactaatttatgaaaaaacttctttttctaccaactaagaggttgattttactgtttaaaagagttaaaacaacaaaaaactactctttaataagagtagttttcagcattacatgaataggataaataaaatcacacctaggattattcggtatattgcaaaaggcaccagtttgattttattgatcagttttaggaagaatcgaacaacgaagagagccacaacaaatgcactcacaaacccgacgataaagaatggcagcatgtctgttgttaaatattcggcatttttcacaagtgttaaaaagcttgcgcccgccataatcggcatcgccatgataaatgtaaagtcagctgccgcacggtgattcaaaccaagaataaccccacctgcgatcgtcgaacccgagcgagagaagcctggccataacgccaaacattgaaacagtccgatataaagcgcctgtttgtacgtcatgttatcgacagagcttgtttctgttttacgtttattgatccagtcagcgacaagcatcagcactgcgcctaaaatcaaaccgactgcaactgttctcacatcaaacaagtatttatcaatataatcttcaaataagaatcctaaaatgacggctgggacgagtcctactgcgatttgagcaatggtcagtttatgcccgctgcgcttttgttcttcagtgatatttttctttaagcctaacaagttcaaaatccgatccttgaacacaatcatgacagctaaaatagagcctaactgaatcacgactttaaatgtgtttgccgcctctggcgtaatgatttcctttgattttaaccatagatcatcgacaatgatcatgtgacctgtagacgagacaggtgcatactctgttaatccttcgacaattcctaaaaccagtgccacgaataaatcccatagattcatgattttctttcctttcaattctgatcttttgaacaggcaaccatctatgtccacataaagacaagcttccttcatcgaaagctcgtctttatgatactatatttttttcaaaaaaagattatgacattaaaccttttcttctttatacaaattggatcgcattttgaaccaatcaaacaagtgggtcgtgatgaccttcaggacggcatatgtcggaatcgcaacaatgataccgactacgctgaacaatttacctgctgttaagagaacaaagataatcgtgatcggatgaatatgaaggtttttccccatgacctgaggtgaaataaatttcccttcaatgagctgaaccactgtccagacaatgatcagttttaaaagcatcactggtgatgtcacaagtgcaatcacaatcgctggtgtaatcgcaatcgttggaccaaggtatggcaccacacttgtacatgccgcaatgattgctagcagcaacgcatagtcaagtccaataatcagatagccaattagaagaagaacaccaatacagaagctgacaatgatctgtccgagaatataagagctcaggcgatggttcatttcgtgaagcacgatatgagtatgttctctaaacttattcggaataaatttcaagaaatagtcaggtaattttttgccgtcttttaataaataaaacagaatgaacggaacggtcacgatcgagatgatgatttcagtgagcgcccctaagaacgtccccactccggtaaaggtactttccaaaattttcgtcgcttgacttgacgctttgctcaccaattcagagacgttaaaattcatgtttttttgcgcttgattaatgaagttgcttcccgttagttgtctaatctgatcttctaccgtatcaacatatttcggaaggttatgaaacaggctcatcatttgtgcttgtaaaaaaggaataatagacacaatcgtcactgttataatgccaataatgactatatataaaagcaaaatcgaaaagattcgtttaactctaaacctctctaacaaattgacaatcggatttaataaataatacacgacccccgttaaaataatcggtaaggcaatcgttttgacgagtacaatgagcggtgtgaaaataaaggatgttttcatgaaaacaaggatattcaatccgattaatagcaggacgagtaaaaagagaacaaacttgttatcaagaaaaaattttctaaatcgactgctccacatttgcatagaattcatatcgttcctccaaactcgggctattttataaataaattgtacactacctgatcatgatatagtggtcattgtttcagctttttttcccatttcgcaatggacatcacccatacaatcagaatgggctgtcctatcagtcttatccatagcaaagactgctctgtgctttcttgacctgggaatggaattccctctcgtgcagcaaataagtttgcagggaaaatgaggacaagatagacagcaatgatttttgctgctgcgatcctgacatttggcaaaagcagcaagacagccagcagccattctaggcatgccgtcgcatagaccattacatatggatatggccagcctggcatcatacgggcaaagccgctcggctctatcacatgaaaaataccggctgctatgaataaaagcgcaaagacgtatgtacttcctatatgcaggacgcgcttcatggtcgtttcctcctctcccttctatcagagtattacccgaatgaaggaagaaactacccacttctcgtacatttatatcctttatgtaagacgcatcagcctatataaaggtttcatccgcttttcaataaaaagaatgttctttcttacaaacgctttcaaaggatgtataatcagagaaaagcagaaggagggaacgacatgattcgatttgctgtcatcggaacgaactggattacagatcgattcttacaggccggtgaaggaatagctgattttacatgtacagccgtctattcacgatccgctgaaaaaggccaggcatttgccgaaaaatacggtattgatacagtttttacgaacttacatcaaatggcagaaagtgatgcgtttgatgccgtgtatattgcgagtccaaatgcccttcataaagagcaggccatgttgatgatggagcaccaaaagcacgtattatgcgaaaaaccatttgcctctcaccgaaaagaagtagaagaaatgattgctacagcgaaaaaacatcaagtttgtttaatggaagcgatgaaaacgacatttctgcccaacttccttcaaatcaaacagcatcttgatcagcttggacccattcggcaagtggtcgctcattactgtaaatattcctcaagatacgatgcctaccgaaatggcgagattccaaatgcttttaagcctgaattatccaatggttctttaatggatattggtgtgtatctcgtctacccggcgatctatttatttggtctgccgaatcaaatcaccgcgagaggctataagctttcttctggtgtagatggaagcggctctgtccttatgcaatatgacggacatcaagcattcctttttcattctaaaatttcaacgtctcatttatctgcggaaattcaaggagaggatgcgacgatggtgattgatcaattccaccgtccttcacatatcacgatccatgatcggcaaggacaccaaaccgacatctctctcaaagatgatcagccagccatgtattatgaaatctgtcattttattgagtgtattcagcaaggaatgagtcagtctccggtcaatacatttgccttatctgttcaaactatgtccgttatggacgaggcgagaaaacaaatgggcgtgaggtttcctgccgatagataaaatgaatggggcatgaaatgatgaacaaagggcgaacatgagatgcaaattcgccctttgtttattttggatccatagtttatgttgccgctaatacatccgcaaatgctttcacatagggaggaagatccggtggacgtctgctcgagacgaggtgactatctatgacgactgcttcatcaaaccagtctgctccagcatttgtcatatcatctttaataccaggtgtacttgtcactttttttccttgcaggattcctgctgaaatcaatacccatccagcgtggcaaatttgcccgattggttttgccttttcatcaaatgaacgtacgatatttaacacttctgcaaaacggcgcagtttatctggcgcccaccctccagggacaagcacagcatcatattcatccgcttgaatggaataaaaatctgcatcagatacagccggcacaccatacttcccagtgtactcatgatttgctttttctcctacaaggtgcacagttgccccttcttctcttaaacgcagaaccggataccatagctctaaatcttcaaaatcatcactgacaaacgcaatgatcttcttatttgataaacgcatatcatctctcctattctttcgatttcctctattgtacgagatgaccgcttaaaaagaaaagcggttccccttgaggagaaccacttgaccttattcactgatcttgaattttttaattaaatcacgtaattcttccgccatttgggaaagagtcgtagaggaagaactaatctcttccatagaagcaagctgctcttcagcagatgcagcgatatcttggatgcttgctgaactctcccgtgatacatctgcaatttcattcactgctttagaaatttgctcagatccttttgaaagctcgcgtactgttgtattcatttcattaattcttgtagcgatttcgactgtttgctgattaatttgtgagaagctttctttcgtttgatctgtaatggaaagaccattcttcacttcttcatttactgatttgaacatattttgagatgtttcgatttcagatacgatttctttcacaagcttttcaatctcttttgctgaatctgatgattgaactgcaagtttacgcacttcctctgcaacaacagagaagcctctgcctgactcacctgcacgtgctgcttcaatggctgcattgagtgcaagtaaattcgtttgatccgcaatgccgttaatcacgcctaggatgtttgtgatgtcttttgatttatgctctagtccattgatcaccccttcagcttctttcactgaatggtcgatcgtcttcatttggccaacggtttgctccacaagctgtccgcctgattccgcggctgttcttgattgaatagatgacgctgtgatgacatcagatgtttctgcgacttcgttcagtccctctttcatttgttttaaatgagccgcactttgctccaccatttcgctttgattttcgttgccgtttgagaatgtttcaatagatgatgtaatatgttcagttgcttttgttgtttggcctgcgcttgccgtcagttcttcagatgaagaagccacgttttctacagatgtttgtactgcttgaatgacatctcttaatgattcactcatttcattaaagcttgtgcctagctgtccaatttcatcttttgaccggacaacaattttttctgttaaatctccctcactgattttctttgaagaagagacaagtatagaaagtggttttgtaatggaacggatgatcaagaagatcagaatcccgccaatgatgagcgcaccagctaaaatgatagcggccatgttaaagactggctgtgcagcttcttcgacttccgtcacaaacatcgtaccaacaattttccagcccgtcgctttgtttgtggtgaattccatttgcttttcttttccttcaaacatataactcatagaaccttcatcttgtgaataaagcttttctagccattcaccagataattttgttccagcttttttcgtaggatgggcaacaaaggtacgatccggacttccgataaaggcatagccttgtttcccaatgtttatgctatttgattcttttactagattcgcaatgtctaagttcattgcaatgactcctgatccgtcctctaactttttagagatggtgaccacaagcgtacctgtggaagctgttgggtacggtgctgaaacagacagctctccgtttttctcccagccgtctttataccaatcccgctccgttgcgacataatcagcaggcatttttttgttaggatatctcgaaaacactttgccatcacttgaagcgacaaaaatgccttctgtgtcatcattcatactcatgaactgctcaaagcgtccttgaatatctgtcgtgcctttttgcttaagctttttctccgtgatccatttgctaaagaaatcggctgcgtctgttttcactttcacaaccttcgtaatatttttatctagctgctcgacgttctcctttgcactttgcatgatttgatcatttaaggaagtgctggccgtatgatatgaagagaatgccaacacaatgattgggcataagagaataaataagaaagagaatacgagcttttttgaaatagatggcttcctgaaatactgtatgaatttcataaaaaagaaaactccttttagtaagatagtatatatatcggaagcactactaggttgttaacttttttaacttattaaagtctaaataagaccaaattacccaaattatatgtattgaatggaaaaacacctgacgccaaaacgtcaggtgtttccctatactcttatattttaaattgtttaatgagctctcttagctcttctgccatctgagataacgtagcagaggatgagctgatctcttccatagatgccagctgttcttctgcggatgctgcgatatcttggaagcctgcagagctttctcgtgaaagctctttgatttgattcaccgcatgtgaaatatcatttgagccatgcgaaagttctttggctgttccgttcatttgtttcatttgttctgtcatttctaatgttttatcggtaattttctcaaagctgactttcgtttcatctgtaatatttaatccagattgtacttcacctgctacttgtttaaacatgttctgtgatttttcaatttcctctacaatctcgttcgtcaagctttcaatttcctttgaagagcttcctgattgctctgccagcttacgaacttcttctgcaacaacagaaaaacctcttcctgcttctcctgcccgagcagcttctatcgcagcatttaaagctaagagattggtctggtcagcaatgccgttaatgacacccagaatgttcgtaatatcttttgatttctgctctaagccttgaatcacaagctctgcttctttcactgcctgctcgatggtttgcatttgccctgctgttttttgaacaagctctccaccggcctgagccgttttgctcgaatcaatcgacgattccatcatatgagaggtcgtatcgaccatatgggataagctgcgatccatttcattcaactggactgagcttttttcgatcatatcattttgatgttcattgctgtttgagaactgttcaatagatgatgtgatatgctcagtcgcttgagcggtctgtcccgcactagctgttaactcttcagaggaggcggccacattttcaatggaattttgaacagcttgaatgacttgtttcagctttgatgacatctcgttaaagctatgcgcaagcttgccgatttcatcgtgcgtacgaacttcaatatgctgtgtcagatcaccctgactgattttttcagccgattcagagagcgctatcagtggctttcggatcgatttaataataaaataaatcgcgattccgcctatggcaatcgcaactgccagtatgatcattgttaagtcgagaactggctgtgcagcttcttgaatttcgccaacatacattgttccagcaagcttccagcctgttgcttcatttgtgtcaaaaaacatttgcttcggctgtccattgtattcatatttaaagttgccttgttttttatcatacaatttcgtgatgaaatcacctgtcaatttctccccaggcttgtctgttttatgggcaatataatgctgatctggagtcgcgacaaacgcatagccctctttaccaattttgatactgtttgtatcttttatgatcgtgttcaagcgcatgttgatcccaattacaccagatccatctgctaactgttctgatattgtgatgagcaggtcatctgatgacttgtcgacaaaaggatctgaaatgatgagtttcttatctcccatcgattgttgaaaccatggttcgttttttgcgctcgctccattccctttatgaatctcggaatattcggttagtttaccattttgatctgcaatgaatacttccacaacatcttcgtctgtttccgataattgctctaatttcaccttaagtaaatccttgtttttagaagtcaattcactctttttcaccgatttagataaataagaaacgatatcaattttaggctgtacatctttattaatgagttcgtttaattgctgaacaccatttgcagcactagacataatctcatcattgagagactttgatgccacttcataagaaaatgctgccaatacgagaattggcactaggagaatcgctaagaatgcagtaattaatttcttggacattgtaaaatgcttaaaaaagttgatttttttcatgactctactccttttgaattatgatttgtggtcttccccttctattcttaggtaatacgaattatttttcaagggataatgttcaaaattcaattaaaatgagtaaatttacctatttcttttgatttattcaattgaaaaagagccctttagctgaagggctcttttcattttgtctattcgactttaaatttgctgatcaaatcacgcaattcttctgccattgatgaaagcgtagcagaggaggagctgatttcttccatagatgcgagctgttcttccgctgaagccgcaatgtcttgaatgtttgcggagctttcacgtgagacgcctgcaatctcacggacagcctctgacacatgtgcagagccatttgaaagctggacaactgtttgattcatggtttgaagctggtcagaaatttcttttgtcatttcgaaaatattgtggaagctgactcttgtttgttcagtgaagcttaagcctgattgaacttctcgattcaccgcagtgaatacttcctgtgatacatcgatgtcttgaacgatttctttaatcaaattctcgatttctttcgccgaattggctgattgaacagccagttttcttacttcttctgctacaacggagaagcctctgccagattccccagctcttgctgcctcaatcgctgcatttagcgcaagtagatttgtttggtcggcgataccattgatgacacctagaatttgtgtaatgtcttttgatttactttcaagagcgctgatgacattctctgcttttttcacggactgatcaatgacattcatttgagaagcggttttttcgacaagctgtccgccttcccctgcgatatctgttgatttgatcgatgaagcagtaatggattcagccgactcattcatgtgctgaaggccacggttcatttcctctaactcgtctgagctagattcgactttttcattttgactttcatttccatttgagaattgttcaatggctagtgtaatatgctctgttgctttacttgtttgccctgcgctggctgtcagttcttctgaggaagaagcgacattttcaactgaggtttgtacggcaccaattagggttcttaatgagtctatcattgtattaaagctttttccaacttgaccaatttcgtcatctgattggatctgaagcttatctcgcaaatcaccttcgctgacttttttcgagaagcgggcaaggttggataatcttttcgatatagagcggacgataaagaagatgagggtacctgctacgataagtgtcacactgaacacaataagggctgtattgaaaacgggctttgctgcatcttctacttctgatacgagcatcgttccaccgattttccagccggttaattcattggtcacatacgcaacctttttatctattcctttgagtgtgtaactgccgcttccttctttgtttttaaaaataatatttgccagattctcattaacctgacttcctgacttttgggtcggatctgctaacactgttttatctttctccatgatgaaagcatagcctttttgcccaattttgatttcttttaacttttgaatcaaggtgtcaatttccatatcaagtccaataacacctgaaccatctttcattttttgagtaatcgtgataaccattttgcctgtggaggctgctacatatggttttgtgatgacttgtttgccgttttctgcattgagtgcttcttgataccatggacgctctctcggatcgtagccatcaggcatcttttgaacaggatattgcataaacagtcccttttcggagcctgcatagatagcagaaacatctttttcattaatttttccaaattgctgcaattctttaatggtcgtatttctatttttttcttgaagattagacgctttgagtgagtctgtaaacagagccacagcatctgctttatttcctatattctcattgattaaagtatcaaatgcattgacttgactcattgcactgcccataatctgtttgtctaactctgtctttgatgtaaaaaacgcactaattgtcagtgcagtggttggtaggataaggactaccaaaaaagccataattaatttttttgaaatggatggtttttttaaccattggatcattttccccattttctctttccccctttacttctctaaagttattatcggatgaaaggtttaattttacaggctatacatgctgtttaaacataaaaaaaatacccagacaattctgggtattttttcatcgttttttaatcaattttgaattgacttgtgagctcttttagttcctctgccatgtttgcaagtgtcactgaagaagatgatatttcttccatagaggctagctgctcttcagcagaagccgcaatatcttgaatgtttgccgcactttctctagagacttggcgcatctcctgcatagcttgtgaaaccagcttcgaaccgctcgatagatcaatggctgtatcgtttaattgcgtcagttttttcgacattccttctgccgcctcataaatgttctggaagctttcttttgcttcttctgtcataccaagtcctgcatgtacttctcgattgaccgttttgaacatatcttgagatttagcaatttctaacacaatttcttgaatgagcttttctatttctttcgctgagtctgccgattgaacagctagttttctcacttcttctgccacgacagagaagccgcgtcctgattcgcctgctctagctgcttcgatggctgcatttaacgcaagaagattcgtttgatctgcaatgccgttaatgacatttaaaatgctcgtaatatctttagacttatattctaattgcttcatgacttgttctgcctcttgtacagatgtatcaatatgtttcatttggctcgctgcgctttcaacaattcggccgccttgaccagctgcctctgtcgattgaagtgagacagaagccacttctgatgacgtttgtgacatgccttgtaatccttcattcattgccacaagctgattcgtactagattcgactttctcgttttgtgcttcatttccatttgagaattgttcaatcgacattgtgatatgctcggttgcttgacttgtttggctggcacttgccgtcagctcctcggaagcggatgccacattgtcgacagactgctgaaccgctcgaatgacttcacgtaaagattcactcatcttgctaaagcttcttgtgagatctccaatttcatccttcgatttggtttcaagggtttcggttaaatcaccctcgctcaccttttctgagaaatcaacaagctttcgaagtccaattgtgatggagcgaacgataaagaagatcgcaataccgccaaggataaaagaagaaattaaaagaataatggcagaattccaaactggctgtgctgcttcttctgtttctgatacaaacatcgttccagcaattttccaacctgttaaatcatttgtcacaaaaacgaggcgtttttgttctcctttattctcataagttgatgttccttctttgctgctgtaaaggattgatgaaatgttccctgtaactgcagagcctgatttttcttctggatgagctacaatttgcttatttctatttgcaataattggatatccttctcgtccaattttaatgtctttgattttatcgacaatatcctgtacatcaatatcaatcccaatggctcccgatccgtccttcagacgctgagcgattgtgacaaccattccatttgttgtggcagagatatatggattggtgaccacaggttcacctttttcgtcctgcattgctgctttataccagtcacgagtcgttggatcatagccttttggcatgtctactttagggaactgaataaagtcacgttttttacttgctgcataaaacccaaccacatcatcttcattgattttgctgtatatttcaaaatgctcatacagttcgtcctggtttttctttttaaaatctgcagcactggatgtttcggtaaatagtttgactgcattttccttattcaaaagcttttgctcgatcatgtcattcagttcattgactcttgcatttgctccgtacataatttcatgatctaattcttctttggcaatctgatatgaaatcgtactgagtgtaataattggcaagacaagaacgagagtgaatgaaataatcagcctcttagaaatcgatggttttttcaaccattttattgcatttttcatgtttttcctccttttaaacgatatgttatatatcggacatcttcatattattttcatgtttttcaaataaaaaggatgcatttttgtttatttccacaaattgattccttgcccaagcaccctgcatacgctaatacaaaagggggcgcttttcatatgattatcctttcaggacagccagtgacaaatgagcagctggcttcatttcagctagaaggacaaaagcggatcattttgatgcagttacaagcctcaaatgatacattccgcttcaggcaagcatctgatttgttatttgaggtcactttgagatcgaacattatgaatgctgcaagagatttgcataaaagtggtgcctcatttgccatctttcaaaggtctcgtgcaaatgacgccttttggcgcgtatctgaagcaggagcactagagctgcgctatcaagtcgaaccatctagaggcattaaagacatttttgaaaatggctcacaatatgcctttgaatgtgccaccgccattgtcatcgtgttttatatgggcgtcttacaaacggtaggagacgagaagtttaaccgaaggcttcgcagtttaaccctgtatgactggcattatgatacattgtcgatttatactgagcgcgggaatgactttatctatggagattgcttatatttcgagaatccagagtttagctatcagcagtcacagtggcgtggggaaaatgtgatttacttaggagaagatcaatattacggacatggacttgggattttaacagcggccgaaattatcgataaattaaataagagaaggcggccaggtgctgttcaatctgcttatttattgccgcagaccacccggatggatgtgatttatctcaggcaaatgtttggcagctaaaaaaagcctcttgtctagtggttatgacaaggggcttttgtatgccttgcgatttcgataatcttgcagcgtgccaagcatcgtgttcgcaaggatctccattttttctaagtcttttcttgtgacctgcggatcatgccagctccattttacataacgaacaaaatagtaatgacgaatgggcgtaaggacggcaggagagtgcggaaattcatcaaaccaaaattcaatttggcctttttttcggtatgaatgttttaaaatgtccaccctttcacaccacccaacatgattttatatgtgcgtcagttcatgcatgatctcctcaacggttaaaatcgagtgaatacggccaactccctgtcctgcccaaagagccatttgatcagggtttcccgccgcagcggctgcttttcgcatcggtgttgtccatacatgctgaaccggataaggaagaaccctatcttcattctgtctttcttcctccatccactgattcacaatacctcttgctcttttccctgagaaaagcctcgtgatctttgtttcactgctttctgcctgtaaaatcgcctttttgtatacgtctgccgcagcactttcctgactggctaaaaatcgtgtgccgatttgaacggcatctgctccaagcgctagagcggcttctacacctgctcgatctgtaatcccgcctgcggcgatcaatggcacatgacagagcagcttgacgtcagagatcaggctaaagagtcccactagggcatctccttttgcaggtaaaaaggtaccgcggtgacctcctgcttcacttccttgcagaacaatggcatccattcctttttcctctaaaagcagtgcttcctcttttgtagtggcggttccgattaaaaagatccccttttgttttaaacgttctatcgtttgttcatttggacaagagaaggtaaaggaaacgaccggtacgtcttgttccaaaagaatgttgattttctgttcaaaatcatgccacaattcctcttcgctcggcagactatcagctactggtcgtgctggcagtctcttctcccaaaatgccacatcctcttttttgacttcagaaattggctctggtacaaatacattgacctggaactggcgagttgtcagctgtttgacctgtttgatctgctgcctcaaatggtcaggctgcacatatccacttgccaaactgccaagtcccccgcattgcgaaacagcggctgctagctgcggtgtcacggcacctcctgccattggtgcttggataatcccatatttgatttgcagtaatttcgtgaaatcccccatttatttcccccatctcttactcgtttgatgacacctgtatataaaaatggcgatgtctcggcccgtcaaactcacagaaataaattccctgccatgtgccaaggacaagatcaccatgatggatgagaacatgctgcgaagcacccatatagctcgctttcatatgagcggctgtatttccttccatatggcggtccttcggatgttcccacggaaagacttcgtcaagcctccggagcatatctcgtttcacatctgggtctgcattttcattaatggtcatccctgctgtcgtatggggacagtagacgatgacacttccgttttgaatacctgtttccttaacatattgatggacctcattcgtcacgtcgatcatctcatcgcgtctatttgtttgtacattgatttttttcatatgagcggctcctttttgtcatttctataaaaccataccctttttatgtggaatcaatcactgttgatcggtggaagacattctcccacctaaagtttaccaagtaaaaaaacctcgtcaagcgtgacgaggtttttaagaaaagtggacctttttgatttcaatggtccgaatatgatggtcttccgcatctatgatggtaaattcacagccttctgcttcaatcgtatctccaatctcaatatcaaatttatgtgtcatcatccagccagcaattgtatcaacatcatcattctctatcgctaaatccaataaatcatttacttcatcaatcaaggcttttccatccattacatagtggaagtcaccttttttaacgatatgaggtgtttcgtcctgatcatattcatctcgaatttcgcccacgatttcctctaatatgtcctctactgtgacaagcccggctgttcctccgtattcgtctacgagcactgacatatgaatgcgttccttttgcatcaaaataagcaattcttgaacaggtgtactttcaatcacacgaatgaccggacgcattaagtcttcaatcgtcacatcttgattcaggaaactcgctttaaacacatctttgctattgataacaccaaccacatgatctttatcttctttaatgacggggtagcgtgtgtatctttcgtttagcatataatgcgtcacgtcttcaagcgtctgttcaatctctatagctgaaatttctgtacgagggatcatgatctctctcgccactcggttatcaaattcaaaaattttattcacatatttgtactcagactggttaatctcgcccttctcatagctttcagataaaataaggcgcaactcttcctcactgatcgccacttcatgttctttgacagaatgaaaaccgaataatttcacaatgcctcgtgccgccccatttaatgctttaataaacgggtacatgactctatagaaaaagataagtggctttgctgtcacaaggctgaccgcctctgccttttgaatggcaatcgttttaggcgcaagttctcccacaacgacatgtaaaaacgtaatgatcacaaatgcgatgataaacgataggatgtcggttaatgcggaatgaagccccagctcctcaaatagtgggtgcagaaaatgctccaccgtcggctcgcccaaccaccctaagcctaaagccgtgatggtaatgccgagctgacaggcggataaatattcgtcgagatttgatatgagcttttgtacgtgaatggctctcttatcaccgctttcaatcagctgattgattttagagcctctaattttcacaatcgcaaattcagtgacaacaaaaaatgctgtcgcagcaatgagtaatatgactaaaaatacgtttaaaatatacaaaaaaacccttacctaacaacggtaagggctcacctcctctggcatcaattaatcattacggccatttaggaagatcattacaaaacggagcaattcaaacaaggagacaagggccgctgcgacgtacgtaagagcagcagcatttaacaccttgttcacgcctctttcttcactgcttctaatgattccttctgaaacaatgatatctttcgcacgagaacttgcattaaactcgacaggcaatgtcacaagctgaaagaacacagccgctgagaacaaaatgatcccaagcccgattaagttaaggctgccaagtaagattccaccaaggaaaagaagcggggcaacaccagatgcaaagttcacgacaggaaagatcttatgtctcaagacaagcgcaccataggattcctgatgctgcaaggcatgtccaacctcgtgtgatgcgactgaaatggccgaaatggaatggccatagtacacaggttcagataagcgaaccacacgttgcgtcgggtcgtaatgatcagtcaaagttcctcttaccggttcaacaggcacgtcgtataacccgttgcgatctaaaatatgtcgagcggtttccgcacctgttttcatactggatgcttcaacctttgaatatttttcaaaattattctttactttaaattgtgcccaaaatgataatcccaatgcggcaaaagttaaaaaataaaaaaacagcatgctcatcagcttcctttttattttatatatttatttacaattttaatgacttttatgtaacgtgtacagaaaaaagcactaggtctttttaagggggatcaccgcgccaatgaaaaagaagaacacacctaagcatgctgtataaaaggtcaccgttccgtataggttttgaaaaaagtgcagccatgaaaaatcattcataaaatgattcaccgcatttaagtcaaacacaagtaagatcatagctgatgataaaaagtgagcgccgataaaaagaagtacggtcttttgaacgaacgacattcgcattccctccttcttctctcttattttaagatatgggaactacatgacgatgatgaaaaaatgtttcctcaatcgggcatactgatattagcagtttcctgaaaggaagagtccgatgaaatcaaaccgtatctttatcgcttggctaaggtggcctctctatcttcgaattgccgtcatcatctgtttcttgcttctttttttcggacaattaattgtcttgcttgaaccgaagcagtatcatacgatctttgatgggatctggtgggctctcattacagtcgcgacggtcggctatggtgattttgtgccgcaaaccatgcccggacaaatcgcaggtatggcgctgattctgatcggggcaagctttgtcacggcttattttgccacactcgctgccgctgtgttcagcaagcagcaccattatgtagaagggaaggtcgcgtttaaaggaaaaggacatctcattatcatcggttggaatgaaaaaacgaacaaactgcttcaatcgtttcaaacgattgatcccgctatgccgattgtgctgattgatgattctttgaaggaaggacctcttctagagaatgttcattttattaaagggcatggcaccgatgatggcacacttcgcaaagccaatatttcaggtgcagatgcactgatgattaccgcagatcagcacgagaatgaagtgacagctgatatgcagagtgttttaacattacttgcagcaaaaggattaaacccttctctatactgtttaattgaaattttaacagatcgttacgtgaaaaatgccgagcgggctggcgccaatcaagtcattcatacctctgatgcagtcaatcatttaatggtcgagcattttcttttaaaagaacagttcaaaacgttaaagaaaaaaagtcatatgaccttgcataaacaggtcaccatcataccggttccagcttcgttagctggagaaacattcttaacagcactccatcactttttagagcatcatgtgatcattgtcggtgtacaaaaaaaagaaggacccatgatgaatcctccctttgattatgagcttcatccagaggatgaactgatcagcctttaaagcagtgcgtcttctaattccttgacgagcgaaaagccaatctcagtataagcttttgatacatctccatctttctcttttggttcttggaattggttaaaggatgcgcccacatttccaaccatcgcatgatcatctaacttatcttgatagacatgctttaagagaaatggatctcccagtttcaccacaacgcctggctgatccagctggcccttttcagctgtaaacggaactctgagaaaagtatagccatcacgattatcaattttataatcaaagtatccgtgatcgtaatcccagttaccattaatgacataaccgagcggcttcatcgtctcttctaaatggtaaagtgaaaagctttcaccaggcagcctggatggtacatgaatcatatgaaaccctcctttttgtatagggttcgttaaagagaggaattcatacatttgcctttcgtgatttgcacattgtttgtaaatgcggcatcaaataaggtctggctggatgatgcatttgtctcgttcgcactgcccgctccagatgtgtcctttacagcactcattggacaaattcgtccgacattcccaaagttaacaatcgcctgtcctgaaatgtcatggatataaatatgatttgttctcatcgcttcatcaacctcctccattgattattctatgtacagagcttagggaggcttgcactgacaccatgagaacataaaaaaaggcacatcttatgaaaaggtgtgcctttttattcttatgattgttttagacggctctcaagttctgcctttttctcttcgaagcccggttttcctaataaagcaaacatgttcactttatacgcttctactccaggctggtcaaatggattgacgcctagtaaatacccagacatcgcacatgctttctcgaagaagtacacgagatatccaaatgtataagcatccatttcaggaattgtcacaatcaggttcggtacttttccatcagtatgagcaagcatcgttccttcaaatgcttttttattaacgaaatcaaccgtttttcctgctagatagttcaagccatcaaggtcttgtccttctgcttcaatgacaagctcatgacgaggcttgtctacattaacgatggtttcaaacaagtctcttcttccttcttggacatattgaccaagtgaatgaagatctgttgagaagttcgcagatgaagggtagattcctttttcatctttcccttcactttcaccgaataattgtttccaccattctgcaaagtattgcagtcctggctcatagttaatgagcatttcaatcgttctgcctttattgtaaaggacattacggacgacagcatattggtatgccgcattctcagaaagctcagatgaagcgaagtcttcgcttgcttttgccgcaccttccatcatctgatcaatgtctgcaccgctcacagcgattggcaatagacccactgctgttaagactgaataacgtccacctacatcatcaggaatgataaatgattcgtagccttcttccgttgctaatgttttcaatgcaccgcgtgccttgtcagttgttgcataaatacgttttttcgcttcttcagcaccgtatttttcaataaggagctttttaaagatgcggaacgcaatcgctggctctgttgtcgtaccagattttgaaatgacgttaatagaaaaatctgcatcttccaatagatccatcacatcagttaaataagaagaactgatgttgtttccaataaagatgatttgcggcgtcttgcgtttgccttttggcagcgtgttatagaaagagtggttcaaaaattcaatcgccgcacgtgcgccaagatacgaaccgccgattccgacaacaagcaagacatcagagtctgacttaattttatctgcactttttttaatgcgggcaaattcttcgcgatcatattgcttcggtaagtcaacccagcctaaataatcactgccagtacccgtttgttcatgaatattatgatgggccaccttcacaaaatcttttaaatatgtaagctcatgttcttgaaagaaaggtaacgctttcgagtagtcaaattgaatatgtgtcatcgcttgtaagccctccattacgttagttctatccctttcactttagcggaactagctattgaaatcaagtaatcgtcattggtgcagcaaaaagccactccccatgaagagaagcggccatccaaattatagagaggcttttaaaatcgctaaaatgtcatcacggccaagtttcataaagttaccaaagccgccatattccatttcttttgctgcgatgtcagcaattttgtccagttgttcttcaccaatatcataatcggctaaacggcttggtgcaccgaggcttgtccagaaggctgacagcttgtcgattccttctaatgcgatatcacgatcagactttccttctgtctcgatgtcaaacatgttcagcataagatttttaaagcgatccacattgtgatcgagtgtatgacgcatccaatttgggaaaaggatcgcaagtccgcctgcatgcggaatgtcatagacagccgatactgcatgctcaatcgtatgggaagcccagtcgccaaagtaacccatttgcagcgtaccatttaaagcgatcgttcctgcgtaaaggatcgtttcacggtgctcatagctttgtaagtcttcgagcagttttggtgctgtctcaatgactgtttgaagaacagcaaaacacatacgatcctgtagcggcgtgtttttgacattatggaagtattgctcgaagacgtggctcatcatatcgaccatgccgtacaccgtctggttttctggcacagaatacgtatgctcagggtctaaaattgaaaaagcaggatgagtaactgaactaccccacacatatttttcatttgtttcccagtttgtgataacagagtctggattcatttctgaaccagttgccgcaagtgtcagcactgtgccaaacggcaatgctttttgagcggttgttttctttgagataatgtcccacacatccccgtcatattctgctccagctgcaatggcttttgtacagtcgatgacacttcccccgccaactgctaataagaaatcaatgttctcattttggcagatgtcgattccctttttcactgttgtgaggcgagggtttggttcaacacctgacagttcaaatacttcggcctctgcttcgtttaaagcgctgatcacgttatcataaagaccatttttcttaatactgcctccaccatatacaagaagcactcgctttccataacgagcgagttcgcttttaagtccgtctagttgtccttttccaaacattaatttcgttggattatagtaaataaagttttccatctgttctacatctccttaaaacatttatatccaaaaacatgaaagactactgtaacatatgggcatgcagaactcaaaaaaagataactgcttaaaagcagctatcttttccatgttcgattataaagaagcgtttaaaatagctagaacatcttctttgttcagctttttaaattggccaaattcaccacgtgccattgcacggtctgcaatcaagtcaattttctcatcgttgatgtcatagtcagctaaacggtttggtgcgcctagacttgtccagaaagcagatagtttttcaatgccttctaagccaacttcttcgtctgttttgccagcagggtcaacatcgaatacacgcactgctaattgcttgaagcggcctgggttttcttgaatgacatgcttcatccagttcgggaacaagatcgcaagaccgcctgcatgcgggatgtcatacacagcggataccgcatgctcaatattatgagatgcccagtcaccgcgtgcgcccattgaaagcattccattaagtgcaatggtgcctgtgaataaaatcgtttcacgaagctcgtagttttccaaatcattgatcagcttcggtgctgtttcaatgacagtacgaagaagtccttcacacatacgatcttggtaaggtgtattctccgtgtgatggaaatattgttcaaacacgtgagacatcatgtcaaccatgccataaatcgtgtggttttttggcacagtaaatgtgttcactgggtcaagaatagagaatttagggaagacggctggactgccccatccgtatttctcatttgtttcccagtttgtgatgacagaaccagagttcatttcagaacctgtagcggcaagtgttaataccgtaccaaatgggatggcttccattgggacatgcttacgagtgactatatcccaggcatctccatcgtatttcgcaccagctgcgatcgctttggttgcatcaatgacactgccgccgccgactgccaatataaagtcaatttggttctctttgcaaagctcaaccccttttctgaccgttgttaagcgcgggtttggctcaacaccagcaagctcagtcattgtagctcctgattcttttaaaatgctgacaacttggtcataaagaccatttcgtttaatgctgcctccaccatatacaagcaatacgttttttccgtagtgtttgagttcatctgaaagggctgaaacttctccctttccaaagattaatttcgttgggttccaataagtaaatcgatccatgtgatctcctcctcgcgctacattatgcgcctcaatcattccaaaagtaaagtaatttgctttaatccattttcttacgcatagtttggctaaaaatctgcaaaatataaatgtattgatgctgtagcgaaaggaggaatcacgatgagtgctattcagcgtattgccctcgtgctcacgattatcggtgctattaactggggactaatcggcttttttcaatttgacttagtagcagcgatctttggcggacaaggctctgcattatcacgtattatttatggtcttgttggaattgcaggtcttgttaaccttggtctgctatttaagccaagcgaagaagctgttcgccgtgacgagccgaatccagaggttcgctaaacaaaaagacataaaaaaggccgcctatacgaggcagcctaaggcaccgtttgaagcggtgctttttttatttcttgataaggtctttacggttagattgctcaatccactcttcaagtttatctttaagtgtattgaaaccttgtggtgcagcagcttcttctttcgcttgctgtggtctttgtttctttggtttgctttcttttctttctggcgcatcttgtgtcgcacggatagaaaggctgattttacctgcattttcatcaacagaaagaacttttacttgtacttcgtcaccaattgaaaggtgctcgttgatgtcttttacaaagccatgtgttacttcagaaatatgcacaagtccttgagtttcttcatctaatgcaacaaacgcaccatacgcttgtaatcctgttactttaccagtgtaaacactgcctacttcaaactttgtcgccatgataacaactcctaaataaatgttttaatattcgtttatacgcaattaaaaactatatcacagaacgctcttttacgcaaaatattttttaattgggtttagatcagttcaaaagggggaatacctgaaaacaagaatgctttctagtattcccccctaatttgagaggcatcagtcctaatggattgatgcctttttttatttaataatggcaggtgattcttctttcacttgtcgttcttgcaaaaagcgctggattcttgaaagtgattcctgaagatggtcaagagacgaagcatatgaacaacgaatatgaccttcaccactcggtccgaagacattaccagggactacggctactttttcgcttaatagcagctcctcagcaaattgttctgacgtcatgccggtgcttttaatggacgggaaagcataaaatgcgccgtttggctggtgacatgcgagccccagttcattcaaagagccgacaaacaaatttcgccgccttctgtagcttttcttcattttctctacatcttcaagcccatttttcaacgcttcttctgctgcatattgtgccatagcgggcgcacacatcatagaatattggtgtattttcagcatggcatcgcgcagtacaggtggtgctgccacatatcctaagcgccatcctgtcatagcaaaccctttagaaaagcctgaaatgaggatcgttctttccttcatatcttgaatggccgcgacgcttgtaaaagcttcatcgtacgtcagctctgcataaatctcatccgtaataatgagcaggtcatgctctttcgcaaattgagcaatatcttcaagctcttcctttgaataaacagacccagttggatttgatggcgagcaaagcaaaatagcttttgtcttcggcgtcagcttcgtgcgaagatccgcagagtctgctttgaaatctttttcagccgatgtacttaaataaacaggtactccgcctgcaagtgtcgtgagagccccatatgctacgaagcaaggctctggaatgatcacttcatccccgctgtttaaaatcgcacgaaacgccaaatcaagtgcctggcttccgccaactgtgataatcagttcttcttcaggactgtagtcaatgtgaaaccgcttatataaatagccgctcaattcttttcgcaaagataacaacccagcattcgccgtataagaggtaagcccttgttctaatgacataatacttgcttctctgacattccaagctgtcacgaaatctggctcgccgacaccaagggaaatgaccccttccattgtggctgccaaatcaaagaatttccgtatacctgacggctgaatgctttgtaccgtttcagataaataagactttttcatttaaggtgacaccacgattcttttgtcatcgtctcctgtttcaaacactttcccatcatgtttatatctcttcaaaataaagtgggtagttgttgaaacaacggaatcaagtgtcgataatttttcagacacgaagcgggcaatatcagacatagatcttccgcggatcacaacagatagatcgtaaacacctgacatgagatagacagactctacttcctgaaagcggtaaatacgttcagcaatttcatcaaatccgacgcctctttttggtgtcactttgacatcaatcattgctgtgacgccttcgtgaccatctactttacgccagtcaatcatagttgagtaatcaataatgactttttgatcttcaagtttttgaataatcgcttctgcttcttctgttgtcacgcctgccatttttgcaattgtatttaaatcggcacggctgttttcatctaaaatctctaatatttcagtttctttttctgttagtttcatttgatttcacacctcagattgtaaaaagctagttttaaaaaatcttctgaacattatagcacgtttttcccattatgctaagcagggaaaagatgctaatcatagcttaaaatccactttttagggtacaatactgtcacctaacagagagagtatcaagtatcggagtgatgagtgtggacattgttcagccagcttatatgaaaagtaaattcggtttagacatctattacgagcactatccaaatcaggggaagaaaacattgatcttaattcatggtcttttctcttctaccttcagctatcgaaagctcatcccgcttctgaaacaagacttccatttaatcgcgatcgatcttcctccatttggacagtctgagaagtcgaatacgtttatttacagctatcgcaacatggcaaagatcattatcgagctagctggttacttacagattcagcatgcgatccttgtgggtcattcgatgggcggccaaatcgctttatatgcagcatctgaacggccagacctatttgaaaaggcggtccttttatgcagctcaggatatttaaataaatcaaagagatcgcttgtttacagcacatatattccttatttttatctctatcttaaaagaaagctcttgaagcaaggcatcatgaaaaatttaacggctgttgtgcatgatcattccatcattgatcaagagatggtggacggatatttaaagcctttttctgatgatcaaattttccgagggattttccgtttgattcggcaccgggaaggggatttgacctcggatgtgctaaagaaaatggagacacccgttctgctcatttggggcgaggaagatcgaatcgttcccatccaaataggagaaaggctgcacaaggatctgccaaactcgaccttgcatgcattaaaaaaaaccgggcacctcgttcctgaggaaaatccggtctttgtgtctgatcaaatcggacatttcagcctgtcttaacgtgtgcaggagctgctgtctcgtatgacgaaaagctgattcgctatatgttgacagctctcgaatggcaggagctgctcaaatgagtgttgataaatggcttgaatgtcttttgctaaagataaagagtcttctgcgtcgtataatgcactgatgacgtcagcaggctccgtttcatagaagtcctctccatattgaaaagggtcccatgccttaatgagttgaatcatctcttctacagcttgactatctttcatcggtatcaccgcttataataaattttgtgatgtttattttagcacaaccaacaatggttgaaaaacggctagaggtgggtttcatgaatttcgacgaacagatcatacgtaaaggttcaaaatcagtgaaatgggatcaagcagagtctttattcctaacaaaagatgcgctgccaatgtgggtagcagatatggattttaaagcgccacaggtcgtccttgatgcattgaaaacgcgattggatcatggcgtatttggctatgcctttcaggatcaggatacgcagcaggcagtagcagaatggctcaaacgaagacacgggtggtcgatccaaacagaagacgtcaccttcacacctgggattgtcacggcacttagttttgcagtccaagcctatacagaaccaagtgacgaagtcgtcatacagtctcctgtgtacacacctttttatcaaatgattgaacgaaatggacgaacagtctcaaccaatcctttaaaaatagaaaataaccgctatgtcatggattttgatgatttagagaaaaaattaagcagaccagaagcgaagctcatgttcctctgtcatccgcataatccgtccggaagagcgtggtcaaaagaggaattaaagcgagtaggagacctctgtatcaagcacggtgtcacagtcgtttcagatgagattcattctgatttgatgctatacggaaagccgcatgtaccttttgctagtctttctgacgacatagcacatatcacagtgacgtgcattgcaccaagtaaaacatttaatttagctggcctccaagcatctgccattattatttccgatgaagaaaaaagaacccttttcaacaatgaaatgcaaagaaacggactggccaaactgaatgcatttgcaatccctgcgatggaagcagcataccgccatggcgacgagtggcttgatgcacttgttctttatctcgaaaacaatatgaaaatggcaatggactatattgacgaacatcttccaaatatgcgttatatgaaaccagatgcttcttatttattgtggctggacattcgggattatcaattcagtcaagcggagttgaaacgaaatttgctaaaaaagggcaaagtgatcctagagcttggtcacgtgtacggactcgaaggagacggctttattcgaatgaatctcggctgtcctgcttcaacagtcaaagaaggattaaaacgccttcatcaagcgtttacgcaatcatctgattaagacctatatgattaaaagaacatcctcacgggtgttctttttaaagaaaaaaaccctccttttatcatatctactttgtaaatgaaatgatataatgagaggaattacaattatttacgaggagagcatttaaatggaaatgttcaaggattttctgctccatgtatcttttattctatttccaatctttttatatcatgcgctatggctaagccggacccctgctcatttcccaaaaacgaataaactgctcatcacagtattcgcatccatctcttcagcactatgtattatgtatccagttggttcgattttagacttgcagactggccttcaatccatccctcttgtacttgccattttatacggagggtacacagctgggatcgtcgccatcttgataagttccatagtcaaattcgtgatgtatggctcttttttatgggttggactcattgtcgtaccgatttactttttcatcccatttctgttctaccggaaatggcgtcaatattcgaagctgaaaaagctgatgtatggagtgcttatcggtttatccaaaggattctttatttacattggactatttgcggtcagcttaatggaatacagcccggcctttattatgcagcagaagttacttgagttatttttctcaactctttactacatattctttctcgtgctaagtatctattccattgaattcgtcaaagaaaatgcgcaaatgagaacacagctcgtccaatcagaaaagctgaccattgtaagtgaactcgctgcaagcgttgcccatgaagtgcgcaatccgctgacagtggtgagaggctttattcaattactcttttctagtgacaatacaaaagagacgtcaaccaataaagattataaaaatctcgttctgtccgagttagacagggcgcaggatattattacgagttatcttgacattgcgaaacaaaattattatcaaattgaatctctcaatctatctaaattactcgaggaatgtgcatcactgatgacatcctatgcgaatttcaaatcggtcacaattcatcaatccattgaaccagacttatacattcaaggtgatgaaacgaagattaagcaagtcatgattaatttaatcaaaaatgcgattgaagcagccccagaacacgaaggggaaattgaactttttgcttcaaaagaaaatcataaaatatgcctttgtttcgtggataacggtgtaggaatgacagaaagccaaatgaaaaagcttggcgaaccatattacaccctaaaaaataaagggactggacttgggctgaccgtgacattttctatcattgaaaatcaccatggaaccattcgtttcaaaagctcactgcagtctggcacaaccgtcaccgtgaagtttcctgaagatacaagaagaaaatgatcaatccattttttttgtccttttttcatctatccgctcctgcttcttagacgcacgaacgatcagacgaaagcaaattaatgcagccataaagaaaattaccgtggtgattgccgctgggatgtactcccttttatcttcaggaaaatacagtagaaagagtgcgatgaacgacagcattcgccattcccccttttgctcgtttacttcactatattggctaaaagaaatgaaataccttcctgcgagaaggaaatggaggaatttcacatgacagacattcaaattggacaagttgtgaaaggattttataaaacaggtgtttacgttggggaagtgacagcagtgaaaccatcggcctatctcgttcaagtaaaagccgttctgacacatcccactcaaggcgacctgcatcacccaaaagaagcagacgtgccttttttccaagaaagacgggctttggcctatcgtgaacagacgaatatccctcatcatatggtgaagccttatgatggcgttataccagattatcaagtatcactaaaagaagctgtagaaaaattaaaacaagcgctccatgcagatgattcaaaatgggcggaaaaatcaagagcatgcctatcttctctcgaaaaagattattttccagaagacgcccgctaatcagccgaatcaaaaaagtgtgagaaatcgatcagctcaccaattttggtggtttgtggattttccacataggctctatctttttcaaaaagggttaacagctgataagtcgtcatggcatcatcaagtgctttatgatgcttaccagctccttcactgccgtattcctttgccgccttgcgaagccctgtcagtgtgcgatcaccaaaaaaggttttatattcaaaggcaaggtccctcagcttccccttaaaaggaaaggcaatgtgattgagcatacagttttgcttcagcactttcatgtccatattgccccatgtaataatctcacaatcctctcccccatcaagcgacacaagcttctcgataaacgcctcaaaggaaattccgctctctacatcctgctgcgtaataccgaggaacgatttacagcgcttcgtcagcttcgggaacttttttggtttgacgtagctagagaacgtatctatgatcttttcacttgccgctttcactaccccagcttcaataatttcaggaaaaaaattttgcggatgatactttccatcaggcatcgtaaattcaaaatcgaccacaagcaccgtcttctgttccacaagtctcacctcactttttcgtcagtttttcattctgataccattatattaagacggaccttgaaatcacttcattttcttgaaaataatgcagattcactatgcccaacctatccatcagatgaaagatcgtttattttcctttataattattaaggaacacgaaataaataaagaaggtggtctctatcacaaacaggaagaaaaacttttacatcatgtggtttgtgaacttttttgtatctgccagcattacaatgatcgtcccttttttatcactttacatagaatctcttgatagcagttattcaaatgaatttgtccagagatggagcggatatgtctttggggtcacgtttttaacagcctttctgatttctccgatttggggacggattggagaccggcatggctataaaaagattttgctcattaacgggattgggatagcaacaagtattctattaatggggcttgtgcaaactgtttatcagctattcgccctgcggctcttcatggggcttgtcacgggctttatctcgacttcaatggcactcatctctgcacagacagaaaaagcaactgcgggtaaaacccttggcacgatgcagatgagtaatgtcgccggaggattgtttggcccattaatgggcggattcatggcagacagcgtcggatttatttatacgtttttcctcacagcggctgtcatttatgcgtcagcaattgtgattattttcggagtgaaagaacagcccatccgttcaaaagaagcgaggcgcgtttcttactcacggaaggatgtgctcgttcatattttcaaacagcctttgcttgtcgtcacgatgctattaacgtttattacacaagtagggaactttagcattcagccgcttttggctttatacattcatgatttacacggtcctgttaatctcgcattttatgcgggtcttgcattctctgcaactggacttggcaatttgctctttacacgaaaatggggagatctcggagatcgaattggtcacgacaaggtgctgcttgcccttctcattctctcctctattttattcatcccgcaagcaatggtggattcctatgcgatgttagtacttttccgttttctatacgggatggcacttggcgggattattccatgtacgacggcgtatattcggatcaaagcccctgcctctatgcaaggggaagtgctcggatataatgtcagcttccgctttcttgggaatgttgtcggtccggtgattggcggcattgtcgcgagtcattacgggattccagctgtcttttatgtcaccgccggtatttttctatttggcgcattatttttatgggcagtccgctcacagtcgaaggcaaaagaaaggagtgtctgacccaacatcagatgctcttttttcttgtgtagaagccttattcactagacttcaagcccattcttttctaaaaataaccttctcgtattcgcaaaagaatggtacgatatggctagaaaattgaagaaagtgagtgacctcatgtttcgtgcaatgattggttggttattacttgctgccctcattccattatttattctgactttttatctatcaaaggaagaagctgcaagtgtgaagcctgtgaacgaagtgcttgatcagaaaatcaagctggaaaagatagatttttcccaaaacagttatatgtatgaccgggatggttccctcatctccgaaatcgtatcaaacgatgaaaaccgagtgtttgtcacgtatgataaaattcctgatcatgtgaaggagctgttcctccgctcagaggaccggaacttttatgaccataaaggcattgactttatgggagttgttcgtgcccttgcctcaaatgtgaaaaaccatggcatcagccaaggcgcaagtacgatcacacagcaattatctcgtaatttatatttaagccatgaacgttcgttcacccgaaagtttacagagctgctctattcctatgaattagagcggaaattctcgaaagatgaaattctcgaaagctatttaaatacgatttatttcagtaatggtgtttacggtgtcggttctgcggctaattactattttgataagccgcttagttctttaacgcttgcacagatggcatttatctctgcgattccaaacaacccaacactgtatgacccattgaagcaattcaaacacacaaagaaacgacaagaacgactgctaggtattttagagaaagacggcgtcatcaccaaaaagcaatacaaaaaagccgtcaaacaaaaaatcagcctgtccttgagtgaaaagaaaaacctttaccctgactatgtgacatatgccaatgaggaatttaccgatcttgtgtcagatcaggaaggctttacaaaacgcttgaagaaggccaaaacagatggagcaaaaaaagccattcaaaaagaattatctgaaaaggtcagtaccctacttcaagatggtgtcaaaatttatacggcacttgatccttccttacagcaacgagccgtctatcagctcaatgcgcaattaccttaccaaggtgtagaaggcggatcagcggtcataaatcatgaaacacatcaaattgtcgcacttgctggcgggaagaattataaaaagtttgatttcaactacgcctatcaagcacaaagacagcctggttctgcgattaagccgcttttagactatggtccttacatcgaccaaacgggtgcaacagcttcaagcaaaatcagtgccggcaagttttgcagcagcggatactgtccgcagaactatagtcataaaacgtatggaaccgtcacacttgaaacagcctttaagaactcttacaatacccctgcgatccgaatgctggatacagttggtgtcaaaaagggctttagctatttagagaaattctcattcgaacatatcgtagcggatgattatcgccttccttctgcacttggtggatttacgaagggattctcgccgctagaaataacagatgcgtataccgtctttggtaatcaaggagcttacacgcaaagtcattcaattacaaaggtgacagacttaaacggcaagaccctttacaagtggaaagagtcaccgaagcaagtgtattctcagcggacaaatgacaccatgcgtaaactgcttgcctctgttgtaaaaagcggaacagggaaaaaagcgaatttcagttccccttacattggtggtaaaacaggaacatccaatgactacaaagacatttggtttgttggactgacagatcaatatacaatgggtgtatgggttggaagagatagaggaacggttgaatctatttacagctcaagtccgcacttacgtatttggaaaaatacgatgcaatacgccagataaacaggaggtttggttgccatgcattcaacacatccaccccatttaattttatttgatggtgtctgcaacgtgtgcagcggcgctgttcagtttgtgattaagcgtgatccaaatgagcgaatgatgtttgcttcattacaatcagagacagggcagcgcattttaaaagaaaacggtttgcctctagatgaattcaattcattcatttatattgaaaaaggcaccctctatacgaagtcgacaggcattttaaaagccatgcggcatttaaaaggaatctacagatggagttatttattccttgccattccgcgccctatccgtgattggttttatgagcggatagcgaaaaatcgctacaaatggttcggtcaaaaaacatcttgtatgatgcctacacctgatattcaaaaacggtttctatcataaaaaaagcatcctccactatcggaggatgctttctttgtctgtttatgaaggcagactagccataacactgttataaagcttaataaataagtacaaaatgccgattaaaaacgtggcccaaaacagcaaaataaacatcataaatccaattaaattcagcatggaaagcgattgataaatgcggaccacaacccagataaaatagacaagacctgctaaaacaaagagtccgacaagcagaatcagctgcttcgtcagcagaaatgcaagcaagctggcaaataaataaacaacggatgcaatcctaattttctttaagttctctccttcaggatctttcgcgaaaaagagtagtgccagctctaacaccgtatctgcaatcagtttcaaggcagataaaatcataaaataaacaagtgcaaaagcagcaaaaagagcaagcctgatgccctgttccgagaaaaattccagcatcccttttaaaatgcctgcttgagtcaagaaatcagtcgtaatccctactgtgaaaattgaaaaagcagagctgaatagtaaaatcgaaatcagcggaaaatatccagtcaaatatgtatttttcataaatagatcctttctcataagctcacatttattatggctcacttaaaacggattgacaagatgctttcaaagtaaactggcagcaaaatcaaatttgtgattttgcacgtacattccttcacaaacttacattttcccgttaaagtattactattacgaaaaaatcgtgcgttaggggtatactcgtgaaaaaaacattaagattgcaaactcggctgacgatttttgtttgtatcgttgtcctgatctccctttgtatcactttctttacgatctggtcagaaacagctaagaatattcatcagcaggaacgtgacatcgccctctccactgctaaaatggtcgcagaggctccgatcacagcgaaatcattaaaagaaaatcaatcgtattcagcactgcgtcaatatacaacaagtgttcagcgaatcaccaaaaccgaattcgttgtcgtaatggatatgaacggcattcgcaaaacccatccaaatccgcagaagatcgggaagcgatttgctggtggtgatgaagagccagcattacagggtaaagaacatattagtacggcttctggaacacttggcagatccatgcgtgcttttgttccggtttatgatcaaaatgggaagcagctcggggctgtggcagtagggattacgttaaaggaaattgacttgatcattcatcaaagcttacttccactctacttcgtcacatcgctcagtcttctttctggtatcatcggagcactcattgtggcaagaaaagtgaagaaaattatgtttggactagagccagatgagattgctacattattaaaagaacgaagcgccatgctagaatcaactaaagaagggatacttgccgtcgatcagcacggtaaaatcaagctcgccaatgctgaagccaaacgactctttcataatatgggcattatggttgatcctagagaacaagatgttcaggtgctcctcccttcaagcggcttaaagcaagtcattgaaacacgcaagccgctgcttgaccgcgacgtgagaatgaacggactggagctcgtctttaacgaagtcccgattacagtaaaagatgaaattgtcggggcaatcgccaccttccgtgacaaaacagaagtcaaacacttggctgagcagctgagcggagtcaaaatgtatgcaaatgccctccgtgctcagtcgcatgaatttatgaacaagcttcatgtcattttaggattggttcagctcaaaaactacgatgaccttggcacttatatcaaagatattgcgatctatcagcagacggagacaaatgaaatcatcaaccatgtgaaaaactctgttttagcaggatttttactaggaaaacaaagctatatcagggaacaaggcgcgaccttagaagttatatgcagcacacaagtcccaaattcagaggacccagcagtgacgcatgatctcatcaccgtcattggcaacctgttaaataacgcactcgatgctgtttctcatactgagacgaaaaatatctcgatttcattccgatacgttcaggagcagcttcatattgagattacagacacaggtgttggtctcacaaaagaagaacaagacatcatgtttgatcaaggcttttcaactaaaggagaagacagaggattcggtctctacttcgttgaccaaagcatcaaaaaattgaacggacatctgattgtcacgagtgaaaaaggagaaggaacgacctttagtctccgcattccgtacaaacaaaaggaggattcacatgattaatgtgttaatagtagaagatgatccaatggttggggagctgaacaaacgttatctgacccaaatcgagggctttgaattaaaagggattgccacttcttttcagcaggcactggacatcttaaaaacagaagccattcacctcgtactgctcgatatttatatgcctggacaaaatggactggcattattatcagaaattcgcaagcaaaatcattcggttgatgtcattgtcatttcagccgccaatgaggtcgacgtagtccagcaaacgatgcgcaacggagctgttgattatttaatcaagccgtttgaatttgaacgtttccaatcagcgctctcagaatataaacggaaacacgccttgtaccaaacaatgaacagcatctcgcaaaatgatttagatgcgaagctctttcataaaaaagcagagacggaaaaagtccttctaccaaaaggcctgaccaaaagcacactcaaactcatctggacaagtattcaatcattcggtcatcatgctttcacgaccgaagacctagcgaatcatacagaaatttctcaagtctccattagaaaatacttgaaattccttgaggacatcgaagtagttgatgttgaaatggcatatgggacaattggacgtcctgttttccaatataaactcaatacaactaatatgaatttaattcagcaatatctataatttgacacatctgaccttatataaaggccagatgttttttatggaacacgatgtgacaaaccccttgatatcagtggttccactgtagtagagcacatcgcaaaagcggcattatatcatatttcagcacataaaaagacatcgaatttcgccttttaacatttttttaaaaataaaacaaatttctatttatttattcgattggaaatgataaattatgattgattagttaaccgagatataagtctgatgtcttacatcttctctcatgtcctccataagtttcaggagaaaacaggataaaataccctattcagaagggtgagaagaggtagatcggtcttttttcgcgagacttttctgaaacttttaaattttatagggggttatgttttgaagaagcgcaaaattggactagcattgtccttagtcgtagcagcaggaaccatccttggagcatgcggcaactctggctcaaacagcggtgaaagcaaaaaagataaagatcaattcactgttgcaatggtaactgatgtcggtggtgtcgatgacaaatcgtttaaccaatcagcttgggaaggtttacaagcatttggaaaagacaacaatctaaaaaaaggtaaaaacggctttgattacttacaatctaaatcagacgctgactatacaacaaacttaaacacacttgctcgtgagaaattcgacctgatttacggaattggtttcttaatggaagatgctatatctgaaattgcggatcaacgtaagaaaaaccattttgctatcgttgatgcagtcgtgaaaaaagacaacgtagccagcattgtgttcaacgaaaatgaaggatcattccttgtgggtgttgcggctgctctttctacaaaatcaaacaaagttggttttgtcggcggcgttgactctgaattagtcagaaaattcgaagttggcttccgtgcaggcgttgaagcagctaatccgaaagcaaaagtggaagtgaaatatgctggtgcattcgataaagcagacatcgggaaagcaacagctgaaagcatgtacaaatctggcgtcgacatcatttatcacgcagctggcggaactggaactggtgtcttcacagaagcgaaaaacctgaaaaaagcggatcctaaccgtaaagtttgggtcatcggtgtagataaagaccagtatgacgaaggaaaagtacctggaacaaaacaaagtgtcacccttacttctatggttaagaaagtagacacagcggtacaagacttaacgacaaaagcaaaagaaggtaaattccctggcggcgaagtgatcacttacggtctgaaagagggcgctcttgacatttctccatctcaggacaatctagataaagatgtattaaaacaagtagaagaatggaaacaaaaaatcatcaagggcgaagtgaaaatccctgcaacacgtgatgaactaaaagattttaaagcttaatttgagcatcgggataagcgcgtcttatccccttgcctctcctttacctcctctttattcgtaaaaggtggtaaaagaaaagctgcagcctcgttttgcagcttttcttttgctagtttttatcttcatcagcaccctaaaaaaggagcggttaaacctgtggattatgtcattgaaatgttgaatatacgcaaagaattccctggcattgtagcaaacgataacattacgctgcagctaaaaaagggcgaaattcatgcgctgcttggtgaaaacggcgctggaaaatcaacgctcatgaacgtgcttttcggtctttaccagcctgaaaaaggtgaaatcaaggttcatggaaaacctgtgaccatctctagcccgaatgatgcaagtgatttaggcatcggtatggtgcatcaacactttatgcttgtcgataccttcaccgtcgctgaaaacatcatcttaggaaaagagcccaagaaatttggaaagatcgacaaagaacaagccacacagcaagtacaagagctttctgaccgctatggcttaaaaatagaccctgccgcaaaagtatctgacatctctgtcggcatgcagcagcgtgcagaaattttaaaaacactttatcgcggcgctgatattttgatcttcgacgaaccaacagccgtcttaacacctcaagagattaaagaactcatacaaattatgaaaaacttaatcaatgaaggcaaatccattattttaattacgcataaactaaaagaaattatggatgcctgtcaccgcgtcaccattattcgaaaaggccaaggcattcgtacacttgatgtggaaaacacaaacaaagatgagcttgcaagcctcatggtcggtcgtgaagtttcatttaagacagacaaaaaagaagcctctcctgctgaggaagtacttcaaattcaagaccttacggtaaaagacgcgcgaggaattgaagcggtgaaacagctcaacctctcagtaaaggctggagaaattgtcggtattgctggagtcgatggcaatggtcaatctgaattaattgaagccatcactggtctaaaaaaatcagaatctggcacgatcatgctaaacgggaaagccattcaaaatcttccgcctcgtaaggtgaccgaatctggaattggacatattcctcaagaccgtcataaacacggactagtgcttgatttttcaataggagaaaatatttccttacaaacatattatcagcgtccatactcaaaatttggcttgatgaatatgaaaaatatttaccaaaaggcaaagcgaattattgccgagtatgacgtcagaacaccgagtgaatatacagaggcgcgcgccctgtcaggtgggaatcagcaaaaagccattattggccgtgaagttgaccgcaatcctgatttattaattgccgctcagccgacacgtggacttgatgttggtgcgattgaatttgttcataagcgcctcattgagcaaagggacacaggcaaagccgtcctgctcatctcatttgagcttgatgaaattatgaatgtcagtgataaaattgctgttatttttgaaggcagcattattgccatcgttgatccaaaagaaacaacagagcaagaacttggtctattaatggctggaagtacgcaacaggaagtggggaaagaagcaaatgtctaatcgtttaacaaatctgctcattccgcttatagccattgtacttggtctttttgttggggccattattatgctggcaagcggttatagtgtcatcgaaggctatggcgccctttggaatggcgtcttcggtgaaacctattatatgggagaaaccatcagacaagtgacaccttacattttatcaggacttgctgttgcttttgcctttcggacaggtctctttaatatcggtgtagaaggtcaaatgctgattggctgggtagctgctgtatggatcggtacaactgtccatgcacctatgtacatccacctgccgcttgcactcatcaccgcagctgctgctggtgcattatggggcttaatccctgggtttttaaaggctcgtttttatgttcacgaagtgattgtcacgatcatgatgaactacattgcccttcatgtgacaaactatttgatctcaaatgtcttaacgaataataaagataaaacagaaaaaatcgatgccactgcctcgcttcgctctggtttctttgaacaaatcaccgatttctctcggatgcataatggtatttttgttgctattatcgctgcggtcgtgatgtgggtcattattcaaaaaacctctaaaggctttgaattgcgtgctgttggaatgaaccagcaggcatcccattatgccggtatgaacgttcgccgcaatatcatttatgcgatgctcatttcaggtgcttttgcaggtcttgcaggcgccatggaaggtcttggtacatttgaatatgcttcaattaaaggctcgtttaccggtgtaggttttgacggaatcgccgtcgctttattaggtggaaatactgctgttggtgttgttcttgctgcactgctgcttggtggattgaaggtcggtgctttaaacatgccgcttgaatctggtgtgccgactgaggtcgttgatattgtcattgcgatcattattcttttcgtcgcctcaagctatattatccgccttgtgatgaaccaaatgaagaaaaaggggggaaaataagtgggatttctgcaaattcttgaaatcatcgtcccagcaacacttgtctatgctgcaccacttattttaaccgctcttggaggcgtcttttcagaaagatcaggtgttgtgaatatcggtcttgaaggtttgatggtcgtcggagcattttccagtattatttttaacttgttgtttgctgatacgtttggcgccttgaccccatggcttgggctcctcgtcggaatggcgattggcggattgttctctttgattcatgcagttgcgaccattacattccgtgctgatcaaacggtcagtggtgttgcgattaacatgctggcacttggtgctacactgtttgttgtgaaactcatttacgggaaagctcaaacagataaaattacagagcctttctataaaggtgatattccccttttaagtgacattccgattattggcgatatcttctttaaagatgtttattatacgtccatactcgcattagcgcttgcggttgttgcttggtttgttttatttaaaatgccgtttggtcttcgtcttcgtgcagtcggagaacatccaatggctgctgatacaatgggaatcaaagtgtaccggatgcgctatatcggcgtctttattagtggactgtttggaggtcttggcggagctgtttatgcgtcgaccatcgcgcttgatttctcacatgcgaccattactggacaaggcttcatcgcactagctgctctagtcttcggtaaatggcacccattcggcgcaatgggcgctgctttattctttggatttgctcaaagtttaagcattattggctctctcctgccgctattccaagatataccgaacgtgtatatgctcattgcaccatatgtgctgaccatcttagcactcactggcttcatcggccgggcagatgcaccgaaagcacttgggacaccttatttaaaaggaaaacgataattacgatgtatgatcagtcccctgaaggataaactaccttcaggggatttttgtatgataaaaacataaaaactcctgtttattttacttttattacacttaatttagtttaataaatagatgagtgtcacagaatcttctacaattgagacaaatagcatttgggggtgtttatgtggctaatacacaacaattgaaatcgattacagacgattctgacaataataaaagcgttttccgtaagatcatgtcttggaaaattggtgttattgacttacctgtgtatttagtacttgcagcgattattttaactgccgcttattttaataaaattccagcaaatatgcttggtggtttcgctgttattatgattttggggattttccttggagatataggacaacgtattccgatattaaaagatattggtggaccggcgattctttctttattcgtaccatcgttcctggtcttttttcatgttctgaatccgaactcgttggaagcggttacgtctcttatgaaaacgtcgaacttcctttacttctatatttctgctcttgtagtaggtagtattcttgggatgcagcgaactgttttagtacaaggccttattcgtatgtttgttcctcttgttgcaggaacaattgcagctgtgactgccggaattcttgttggtcttttagttggttacacaccgcatcattcgttcttctttattattgttccaattattgctggtggtgttggagaagggattttgccattatctattgcttattcacaaattcttggtgtatcagcagagtcattaatttctcaattaattcctgctgccgtcattgggaacgtcattgccattatctgtgctggcgcaatgaagaagcttggtgaaaaacgtcctgaactaaacgggaatggtcgtcttgtaaagtctaaagaagcaaatgaaatttttgaacagcctgatatggatccaaaagttgattttgggttaatgggtgctggtgtacttgttgcttgtacaacgttcatttttggtggtttgttagaaagctttgttcatattccaggtccaatcttaatgattgtccttgccgctttaatcaaatacttaaacgtgatgcctcagcatttgcaagatggctcacagcagttctacaagtttgtatcaagaagcttcacatggccacttatggtcggtctagggattctatacattccacttgatgatgtagcaacagtgatttctattccattcgtttgtgtatgtatcgctgtcgttcttggaatggttggttctggttacttcgttgggaaattgatgaacatgtacccagtagaatctgcgattgtgacaggctgtcacagtggtcttggcggtactggtgacgttgcgatcctttcagcttccggaagaatgggtctcatgcctttcgcacaagtttctacacgtctaggcggagcagcaaccgtgatctgcgcaacaatcttacttagaatgtttacttaatcaaacaataaaaagcatgggccctattatgggcacatgctttttttatatttcttttctcctataaggatttattcttcagcagagactacacgtatatattctcttggctgaaatggatattgtcttgcttcttgataggtcatatagagaagatgttctgaaaacaacggccattcactttccgactgccaccttttttgatcatttcgttctatgaagaatgctcctcctaaaatcgtgcagaatatgcttaagctgatgcccgcttttagtttcatgtaatcagctcctttaagaaaagcatgtacgaaatacaaaacaatatacaacgagttttatttttgataaaatattttttgtggtcaaaagaactcaaaacaaatacagtttgctgtaattcagttcaaaccaatgcactatgtctgtatttacgctataattttatttaccagttctttagaacgtgaatttatattgattgaaggaggtttattttcttgcagcttattcacttcgccatcctatcgccttttttgcttgcgtttgttgtgccttttctttttaaatacgtaaagcgtatacatacagggtggtttgttcttatcttgcctattctattatttagctattttgtccaaatgatgacgatgacatcaaatggacgaacgttattttcacagatggagtggattccttctctaggaatgaatttcactgtgtatgtagacggtcttagtttgttatttgcgctattgattacaggtattggtgcacttgtcgtcttgtacagtattttctacttatcgaaggaaaaagaacagctcggctctttttatacgtatttgttaatgtttatgaccgctatgctcggtgttgttctatctgacaatatggtggttctttacttgttttgggagctgacaagtatctcttcttttctacttattggatattggtataaacgggatcgctcacgttatggagcgacaaaatcactgcttattaccgtttttggcggattggctatgctcggtggttttatcctcctctatctgattactgattcatttagtattcgtgaagcagttaatcagcttcagctcattatggcatcaccttactttatccctgccatgatcctgatcttactaggtgcctttacaaaatcagcgcagttcccattctatatctggctgcctgatgcaatggaagcacctacccctgtgagcagttatctgcattctgccacaatggtcaaagccggtatctaccttgtagctcgctttagtcccatctttgctatatcagaggtatggttttggaccatatccatcgttggacttgtgacgttattttggggatcattccacgccgttcgtcaaaacgatttaaaagctatccttgccttttctaccgttagtcagctcgggatgattatgcttatgcttggtgttggagcagctgcaatccatgaaaatgaccccgcctatttcggcgcggccgttctcgctgcgattttccatttaattaatcatgccacgtttaaaggcagtctctttatggcggctggtatcattgatcacgaaaccggcactcgggacattcggaagttaggcggtttaatgaccattatgccgattacctttacgattacgttaatcggtacattttcaatggctggtctaccgccatttaacggtttcttaagtaaagagctgtttttcacaagtatgatacgcatttctgaaatcagctttacagatatttcgacatggagcgctattttcccagcaattgcttggctcgccagtgtctttacgttcatttacagtatgatgcttctctttaaaacatttagaggcaatcttcagttagatcaattagagaaaaagccgcatgaagcaccgattggtatgctcatcccgccaattatccttgctgcacttgtggtcacctttttcttcttcccaaatattctagcttattctgtcattgaacctgcaattgcagccattattccggatgcgattgatccaggaaaacggtttgttgtcaaaattgaagcatggcacggctttcagccagagctttatatgacgataggtgttgtcgctttaggaatcatcggatatttgacgttgtcaaaatggcgtccaatctacaatatcttcaaagaaaaatggtcattcaactcattatatgaccggtcactgatcggcttagaaaagggctcctatcgcctaacaaacagttatatgactggtttccttcgtgattaccttgtctatgtgtttggattcatgattatcgtgcttgggggcgtgatgttttatcagaatgccttttcatttaatatggagcatgctgctccagtcggcacatacgaggtcattctatcattagtcatgatagcagcaaccctcacgactgtgtttgctcgttctcgcttaacagccattatcgggttaggtgtcatggggtatacgctgtcactattttttgttattttcagggcacctgaccttgccctcacccagttaattattgaaacaatttctgttgcactgtttttactttgcttctatcacttgccacaactgagcatgaagcaaaaaacgaggaaatttaaaatgaccaatctcatcatttcagtaggtgttggagtcattgtgacatgccttgctttcgcttccacaagcaatcagtcacttgatacgattgcgtcttactttattgaaaacagctacaagcttgcaggcggaaacaacattgtcaatgtcatccttgttgatttcaggggctttgatacactgtttgaaattaccgtgctggcgattgcggcacttggtatttatggattattaaagacacaaggaaaacggaagagaggagtgcgccgatgagaaaaattgatacgaatgatatgcttttacaagtcacaactaaaatcactgcattcatcatcctgctcttctcccttcacctgtttcttgcgggacataataacccaggcggaggatttattggcggattaatgagtgccagtgctgtcgtccttctgctcttagcctacgatctgaaaacagttagacgcattctgccgttcaactttatctatgttgcagcgactgggctgctcgtcgcgatcctgacgggtatgggatcatttctattcggtgcaccttttctatcccatgcatttgattattttcaactgccgtttttagggaaaacagaactggcaacagccgtactgtttgatatcggtgtatatttggttgttgtcggtgtcaccatgaccattattcaaacgattggagagaaggaataatggaatttctaatgtctattatcgtcggtattatttttatgacggcgacctatttaatgctttcaaaaagcctactgcgggtcatcgtcggcactgctgttttgagccacggcgtccatttgcttcttttaacaatgggtggcttaaaaaaaggagcccctcccattttaactgagggaatcacatcctatgtagacccattaccacaagcattaattttaacagccattgtcattgcttttggtgtgacatcctttttacttgtcatggccttccgtgccttccaagagctgcgaacagatgacatggatcaaatgagaggaaatgatcagcatgaataatctcgtgatcctgccaattttaataccattattagctgctacactcttgatctttatgaataagaacatcatgctgtcaagaggctttagtgtgtttgcttcactctcagccattgtctgcaatgtgtatttagtccaaaccatctttactaatgggattcaaaccctctatttaggaggttggaaagcaccatttgggattgcccttgtggccgatcaatttgctgcgctccttgtactgaccgcttccgtcgttggactagtgacagttcttttctcctttcaaacgattgggaaggaaaaggagcggctgttctattactctggcgtgcaatttttgctcgctggcgtaagtggtgccttcttaacaggcgatattttcaacctgtttgtattctttgaattactgctgatggcatcatacatgcttattgtgctgggcggatcaaaaccgcagcttcgagaatcactcaaatacattgtgtttaatatcatctcatcggctttatttatcgtcggtgtcgcttgtttatacgcagtcactggtacactgaatatggctgatttaagtgtgaagattgctgaatcagggcaaacaggattaatcactgttatttccattctgttcatgattgtatttggcttaaaagctgggatcttcccgctttatttctggcttccaggatcatatcatgcaccaccagcagcgatttccgctctatttggcgctttgctcacaaaagttggtttatatgcgattgccagagtctttacgttaatttttatacacgatacagggttcacccatacacttatggcatggctggccgcactgactgtgatatttggtgtgataggctcgattgcttattcggatgtgcaaaagattgtgatctataacattgttacagccgttggggtcattttgtttgggattgcagccaatacacctgcctcacttcaaggggccatttattatctcattcatgacatggtgattaaaggcgctttatttatgctggcaggtgcactctttgtgtatgctggcacaaatcacttgaaaaagatgggcggactaattcaatctcagcccttattagggtggatgtttttcatatcggctttatcactagcaggaatcccgcctctgagtgggtttgttggaaagctaaagattgtagaaggcggcttttcggctggtcacatgaccttttctatccttgtcttactgtccagccttcttgtcctttattcgatcatgagaattttcatactcgcattttggggtgaggaacaagatacgcgaagaaggaaaccgtcggttaaaggaatggtgtaccctggtgtaatgcttgtgatcttgtcacttgccattgggttagggacagagttcatttccccttatattaatcaagcagcggaaatgctctcaacaccagaaaaatatattcaagctgtgctgaaggagtagatgaacatggcctttcaaatattattaaacgctctcctcgcctttacctggatgtttatgaatgatacatacagagcagcagactttgtatcaggctttgcactagggatggtcgccatttttatgcttcggcgatttttcccacagcgtttttacgggtatgccctttatgcaattttcaagctcttattgatttttattcgggagctgcttcttgccaatttaagtgtattaaagaccgtattatctccaaagctcacaataaagcccggtatttttgcctttcgtacggacttgaaaacggattgggaaattagcatcctttctaacatgattacattgacaccaggtacactggtcatagatatttctgatgatcgttcgattttgtacattcatgcaatggatattgaagatgcggaaaaagccattcatgatatccgggtttcatttgaaaaagcgattcaggaggtgagtggcaagtaatggagatcatcttacaaatttcacttggtattcttgccctgtccacccttctgtttgttattcgagtgatcaaaggtccctctattcctgatcgtgtaagtgcacttgatgcgataggaatcaatttaattgggatgacagctatcgtttctattttgctgaaaacgacaacgttttttgaaattattttactgctcggtatccttgcctttatcggcactgtcgctttttccaaattccttgagaaaggggaagtgattgaaaatgatcgtcatcgctaaagctattgtcattttctttatcctgctcggcgccatcctttgtctcatttcagccattggcgttcttcgcctgccggatgtttatacacgtatgcatgctgcatcaaaagcatcgacacttggtgttgtcctcatattagttggggtattctttcacgaatggtttcttgcaggtattatttctgcgaagattctacttgggattgtctttatctttttaacagctccggtcggcgcacacttgatcggaagagccgcctacaatactggtgtcaagatggacaaacgaagtgtacaagatgattatggtggttttcgtaacttcgtgattaaacgcaaagaagactcgtacttataaaccgaaagaagatcctcacatgcggggatcttctttttatgaatcaatccaacctaaaaaaaagcttccgctgcaccgggagcttttttatatgcgatcaatgacagcaagtgtgcatcttgacgtacagatgtgccggtctcgatcatctttaatatcaatttgaaataccattgtacggcgccctacatgtaccggaacagccgtcgctgtcactactccatcacgtacagattttaagtgattggcattaatttcaatccctgagcaaacttgctgagttaagtctaaatgagccgcagcccccatgcttgccactgtttctgctagagcagcagatgctcctccgtgcagcagtccaaatggctgttttgttctgtgatcgactggcattgttgctacacatcgtgactcattacactctacaatctcaattcccagtgcctcaagcagtgtatttgatccactcacttccatcagggttctctcccttcacacgtttacaacacactttcagattttgcaattaacaccgcttcggttcgagagccaacattcagcttattaaagatggatgtcaagctgtattcaattgagcgtttgctcaaatgcagcacatcggcaatctcttggttcgtgtatcctttttccacttctctcaggatcaaacactctcgctctgttaacagctcgtgatcagtctgctgcgcctgttctggcttttcttgctgctgtgaaattaatttctttaaataggatagctgaatgacaacttctccttgcaatgtgcggtgtatgtattcaataattttgtcttttgtctctgttttactaattgcaccgtgcaatccagcccgaatggcctcttcaaaataatcatctacttcataccctgtataaatgatgattttcacttgttggttggtttctagaatttgtttcgcaatgtccattccattgatatccccgagatttaaatccatcaaaatcacatcatagatggaaaagtcatgcgtctttaaaaaggcggcttctgcatcaggacttaaacaatcgactgatagctgttgatctgattctaatatgctttttgtcccttccatgacagccggatgatcatcaatgaccaatatcttcttcatgtcttcctccctttaaatcactcacttccattttatataaaagacttggcagatgccaagtcttattccttaataaatcgttacaattccatttcaattttcaccttcagccctttttcaggtgctgtgtgaatgtgaagcttcccatttaacgccttgactcgttctctgatgccagagaggcccatgctcatggtgtgctgatcaagatggcttgcgtcaaaaccaactccatcatcctcgtagtgaagaacaacctgatctttaatacaaatcagcattacaagcacttggctggcttgagaatgtttcaaggcattggataacagctcctgaacaattcggtaaatattaagctgggagtcaatgtcaatgtccagctccttatcaaagcgtgtcgtattcagccgaatatgaaacggtgcttcctcctgaatttgagaagtcagcttcgatatcgccttcactaaacctaaatcgtacagtagctgcggccgaagttcatgacatgtttctctcgtcgtttgaatcaccttagacatttgttcattccatgagataagcgattgttcaatagacgttgggcattgatcgttttggaaattcgttaaaaacatctctgactgtcttttcagcgatatcaaatcctgcaacacggaatcatgaagatccctcgctaaatcggagcgctgtttttcctccatcgcaaacatgacttttttcagccaagcagggttcgcttcacgctgcttcaaatcttcaagatgctccatcaattcttcaatcttgacgacattttctaaactgacacttgtgtaaaatgccaatgttttcagccaagaaatctcatcacgcgtcaattttggtgtctgtaaattggataaacagcaaatcacaaatgagtgaccgccccgctcgccaattttcatcatgaaccctttatcaagctcaatgattttcccgacttcccctaaaatatcctgaaattgatccacatactctttccatagattgctatcacctgaagattcatcaatctcttcaatctgtccatctggcttcacttcaagcacaaaggctttattcacaaccagcacttctaaaatggtgtatttcaaatgatataacacttggtgaagtgatgacgcctcacgaatgagctgagtaaatttaaacacactgtcctgataattatgcttctctgaaaaacgtttcagccggaagcggaaatctagaatttctttaaaataaaagacagcaagcataagcgcataggtgattaatgcgagcttcagagtgtactttaaatcttctggtttttgcagaatgtaaaacgtgacaacaacaaaaatggtcggtgtgatggctagaaagccatagtatttcagtctgcttatcaaaaaatccatgttgtaaagcttgttcgtcataaattgatacacgagtgaaaaaggaatgagcaagacaaaagaagttaagaaaaagggatctaccacataaatacgaaacaaaacatatggaattgcaaataaaaatataaaaggacaaaatgctatgatatttatcatgacaaaaaactttaaaacagacccctgctctgtctctttatatttccgcattccattgataatcactttgaatgacatgataatagaagcgaaaaagaataaaagatttaaacttggcatgtatctggctatcgccgaatcaatcggaacaaataactctattactagattaattataggaagactatataaaaagcgaattgttttttgagtcgttatatgcaggtcaaactctttgaaatattgataaatgaaatgaatataaaagataaatacacttgataaacaaaatacgatcacataatggctaaatctctcaccaatccctgaagtacctgcacttagatatccgatacaaattgttaataaaaataaaactaatagaaatgctgattttcgttgggcctctttgttaattcgaatgataaagaagatacaaaataaacaaattgaatacaggatgagaggaattaaatagacaaataaactttcttgaccaatcaatgtcttattttttagggtgatcatttggttgcctctttgaatatcaattctttgcacattcctaagctcaccattgatcaaatgatctttgttgttagcaggttccccattgattttaagtataatatctccttcttctaatcctgatgtgtaggctaaagaaagatattcaactttgacaacttctgcttgaccgttcttgttctccgctacacgtgctccattaaaaatatcaaatacataaatatatgaaacatagatcacaaataaaaaagatagaaaaaccaaaaaagcagatagtttcgtataagttatcttcatgtataaaacatccttaactggagaacttttaaatcatttttaaatgaatcgtatcatttatagtaccatatatactctgcagacatttgccctttcttaataccttgaatgattgctttcatcgtttgctcatctgtatgaattaaacttgcattccctaagtccaattcattcacaacaccaggatttttcactaaatatgcaataacattttgaatgttcaatcattgccctcctttgtcataaatgcatataattgttccttcttcgttttaggtaaatcaagttgttccatttcacgcttcatttttaacagcataacctctctcatcgataccatgtactgagtcaaaccagcttcaagtaacttctgcttcagttgaaaccgcttttgctctgactcatccagccggttagaaaagaaggaaagaagctcttgactggcatcgttaaaacgtctttgcaaataactgaatgccagtgtttgttttttttcaaaatctccgtttgattttgaaaataacgcaaaaaaatcgttactgatctgttcagcaacaccataacatattgaataagattccacagttgcgttgattttccccgtcgctaaataagcacccagtacactagaaagagctgttaatgatcctgattttttccttaaaacctctacacactcttcttctgttccatgcaaatgacgcaaatcctcgtgctgcccttccattgacattttaatgaaatggaacagcttctctactagttgagaattattttcacatattgatgcaatgaattggatactcaccgtatataaatacgtagaagcattgatggccactccttggtcgacgttcatccaaggatacgaatcattgtcctgatcttcaatatcatctaatatatcggcagataagataagaagttcaatccctgctgccaattgtgtaatcgcttgcttgccttgtccgccaaatgcctcataatgctggtaagctaattgaccaagaggaaattctttttttctatctgtaaattctagaagcagcttttgtaaatccttctgcctgaccgcatgttgaataaaatcagacatattctgcttgattttcgtattctctagatagtttagcatactcgatcttgtccctcacccttccgccttttattttactaaaaagacatgagcaaatgtccactgacatcactatttaacaattatataataatatatcctttttttgtatgtatttggataaaaaaaagacttgatgattatcaagtctttaagaaattttcacatattcatatttgtcgtactgatcaatgcttttgttaatgttatgaagagaagccgttgtttctctaatttcgttttcaagtttccataataattgtttaagttcttcgatttcatacttttccatcgattccactctccttttttggaagatcaatgtatttgtgtatggtgattgggtcataagtatttgatctgttactaacagtgtaaatgtaattgagtattttttcaccgaaaagtatgcacaaaatgtgtgcgtgataccgcaaaattcaataggtcttttttcatcattttctgacttttcaaatcatacttttatcttaatttcaaaggaactccgtcatttttgcgacaagaataggcatcattcgtcacacttctctcacaacagaacatacgatccctcctgtaacctcggttttgcgtgttataggtcagacgacaggcccctttgtggacaccgcaattttttggcgacattcaccgaaattgaccgcaaaagtacctatttttatgttggatttataaagatagaaagatgattttgattctttattctgattttctacatacatttagaacagatatccgtccaatttcacgtcaatgagagaagaggtgaccatgtgttttactatgttccttatcctgctttgcagggtcccgcaatgagccgtgcatatccgcgcacgcctatgacttttcctccagtagatgcccactcatttcaacgagccgcaaaggaatcagcccgacttgttgctgatgcttcacttattacacagcagatttccagctccctttcgtttgcacagcggattatggaggctgctgagcgctctgattcgacaagtgtcatccgaatgctgaaacaaatcggtgtgaaaagtggtattgacatccgctttagtccagaaggcattcgtatctacttgtctcttgcctctagcagactttttctccttttacagtgggcataacaaaaaaagccgctctcagcgtgggcggcttttatgattcaaacattttatgacaccattcaatggcttctatataacatccgtaggcttcttgcttcgggagattcccatctaacatctcatgatcccattcatttcgttcaatccgtttggcgacatctagcacaaatgaataatcattttcatagccaagcagtgcctcaccaacttcatcagaaagtggcaactcttttacaagttctgtgatatctgccctgacaagtgtatcaatgagagaaaacatgcctgtcagcatataagaggctgggtgctctcgttcagtacgacttgcaatcagttcacacgtttttgcccgaatgaaggacattttaataatttctttttggcttgagttggcttgaacattcaattctttaaatgaaagaataaagatccaccgcctaatttcattaaaaccaagcagaataatcgcctgccggatacttttgatttgataaagacgtctcatgccgcctgaattgagcatttttaataattggtatgatagcgaaaggtcactttcaataaaatgggtcacaacctggatattcggctgttccttgctcagctcatttaatagctggtggtacgcatggaagctggtcgataatgctcgtcctgatataacatgcggctcactaaagaaatacccttgaaacaaatggaagccggcttctagcgcttcttcatattctcttcgcgtttccaccttttctgcaaggaaacgaagtcgatattttttataggtatgtagaatttttctacgttcttccgatgtggtctttagaaagtcaatttttaaaatatcaatgcaatagaggagttcctcaagcaacttgtcactgaaatgtgatccgcttagaaaaaaatcatcaagtgcaatcgtatatccccatttttttaattccttacatctcataataagtgccggggtaatcgggacattttctaatatctcgatcacaagctgatgcggatcaaaataggtgagcagatcagacgaaagtaagctttcggtgaaattaatgtagcatcttttgccttctgtcaatgtttcgatgccgatatttaaaaaactgttaataatgaggtccgttgtcgcttggtcaccatcttcagcgctatatgtattggtttcactatctctataaagcagctcgtatgatacgacttgttcttttctgttaaaaataggctgtctcgcaacaaacaccctcaactgctccaatcctcctttatgcaatgacaaacaagatgtgctttcagtataccaaatgattgtgcttatggttcattttgaatcggtcaaaaaataaaaaaagagatcacctgacttgatgatctcctttcttccaacattagctttcataaagctctagtttaattttatttttcacgtcatggataaactgcatcttgttatcccagcatttttgactcaaatcgactggatattcttctggtttactgattcgtttatattcctcccagaaaagtccgaggctctcctgcacataggcttgaatcgtttgaatatccggattgtcatatacaagttttccttgttcaaaaatcgggacatgtagatccttcgccacaaagtttgtgacaaatttgctgataaatgtatgcacaggatggaacattttcagcttatcctcactatgaacatcttcctcttcgagcgcaatgtagtcaccctcagagtgatgattcaattgattgataatgcggtacacacgtttacgtccaggtgttgtcactttctctgggttggatgaaattttgatggtatcattcatcttaccattctcttcaatcgacacaagcttatacactgcaccgagagctggctggtcaaatgctgtgatcagttttgtcccaacaccccacacatcaattttggcaccctgtgcttttaaattcatgatggtatgttcatcgagatcacttgatgcaatgatttttgcgtcatggaatccagcttcatccagcatcgttctagcttttttagacaagtaggcaaggtcaccactatcaagtctgacaccaataaagttgatcttgtctccaaattctttcgctaccttaatggcatttggaataccggatcttacggtatcatacgtatcgactaaaaagacacagtctgtatgggtttcagcgtattttttaaatgccgtatattcatcgcggtatgcttgtacaagtgcgtgagcatgtgttcctgacactgggatgttgaaacgcttcccagcacgaacattacttgtcgcctgaaagccgccgatgagtgccgctcttgctccccacatcgcagcatccatttcatgtgcacgtcttgttccaaattctaatgctgtctcatcttcaatgattcctttaatccgggctgcctttgttgcaatcagcgtctggaagttcacaatattcagcaaggcggtttcaataagctgcgcttctacaagcgttgcctcgatacgcataattggctcatttgcaaagacaatttcgccttcccgcattgaatgaagggagcctgtaaaggacaacccgcttaaataatcaatgaaatcgcttttataaccgagttcgtcttttaaatacgctagatcactttcagtgaaggaaaagtccgataaatattcaatcgctttctctaaaccagcaaatacagcgaagccattgtcaaatggaagctttctgaagaagagttcaaacactgccttcttctcatgaatgccgtctctccaatacgtttctgccatgttaatttgataaaggtctgtatgtagtgataaactgtcgtcaataaaccgatgctccaacttccattctccttcccttacttaaccactttcgcaccaagcgactgctcaaagtgagaaagtgcccactcgtgccccgcttcattaaaactcgctacagcattctcgtgaatcacaatttcaaagcctttattgtacgcatcaacagctgtatgaagtacacaaatatcggtacatacgccggctaaatgaagttcagtgatgccacgctcgcgcagtttcatttctaattgagtgcctgcaaaagcagagtatcttgttttttccatatagtagacatgttttaaatgctttgacgtgtgaaatagtgaacttagtttgccataaagttcaattccctttgtcccgcgaatattatggggcggaaataactttgtctctggatgataaaggtcttgctcctcatgatgatcgactgcaaagacgacaaagtgtccttcatcaataaacgaagaagtgatctctgtgatcttaggctcaatcgcctgtccaggctttccgcatgtcaattttccatcgtctgcaacaaaatcaacggtataatcaatacaaatcaatgctttgcccatccgcatctctcccatatgctcttttgactcattatagcttattcatttcactagggaaacctattcaacagattcgtgagaaaaagccttttgaaacagctcatcttctatatagatgtgctcttgattgaccgcatttggcagctctatcacaagaccaaaaggagaatgtgcctcatgatgattcaccactttaaaggaacatcccgcggtattagccattttcacatattgagaataagaagcataggtcaactcaccatttaaaagaacagtggcctgacggttggcctttaatacttgttcgacctcttgatacggtttatttcgtgagacctgtccctttgtcagggcaagaagcgctcgttctcttaatgaaccgagaaacattcttcgttcatcgggttttgtttcagcatgtccaaatatcccttgctgcaaataaaagtctacggattcttctttcatcgctgttttcactcctggttttcatatttacatttctgtgacccagtgcacaatctttagtgcaagttcacgggcttcgtctgtttctgctctttccattaaggattgctcgagtgtatggatcagctgctctttttcgtcctcgtacgcaatggaaatactccattcaatatcaggtacggcaacaagcgttttatattcttttttattttcatgtaaatatacattgtaggtctttggttgcccgcttgtgatgtgtgcttttctaattttcatttggctctgttcacacctctttttccttcttacttccatatccattgtaccataaaaaaagacagcttcagaaaaggaattccctttcaaagctggctacgcattgaagctcttctgctgactaataagatttgaatcccaaacaaatgtgacatttggactgttaaaaaattggacgaagtcacctgcattatacgtacctgatccaccggcagagtgatcgacactttttggcgaaatggcaaaaacatcaccgaaatgtgcagaaccatttccaattacacggtcaatatgaataggcccaacaatcgctggcatctttccaccacctttactcccctcatcatatgcctatgaggaaaatatgtgtctatccaatataaaaaagacagctgatatgtgagcatcagctgtctttctatgcattaaatgattgaggctggccaaacaatgtgaaatcccatagcatcgtcgcattcggatcacttgtaagcgacatataatcacctgaattaaaggctcctgccccgccagtcgagtggtctacagctaatggggcaatggccagtacatcaccgaaagtagctgcaccattgcctcctaatgactcaatatgaataggtccaacgattgcaggcatcagaatctccccctatctgcttatgacaatcatcttatgcaaaaagggaaaagttgtgcatctgccctagacgtttaagtgctgctctttgcgagagcgctgacgtagctgaaccaatctgacaatattcagagtgatggctttgagcagtgcatagacaggaaccgcaaagatcatgccaaggatgccgccaaagcttcctgccccaattaataacaggataatggtcaaaggatgtgtgttcaggcgtttcccaatgatcaatggagaaatgacatttccgtcaatttgctgcacgacaagaatcacaatcactgtcaccactgcttttccaggcgaatcaagaaaagcaatcagcacagctggtgctgctccaagatatggtccaaggtatggaatcacatttgtgaccgcaatgataataccgagaataagcgcatattttacacctattaataagtatccaataaaacaagcgactccgacaaacaaacagacaataatctggccctggatgtaagctgcgagcgtgtcatttaattctttgaagatcttcagcccttccttgcggtaaggcattggcaagaactgtacgagcttgtccggaaacttatgcccgtctttcagcatataaaataaaataaatggaactgtgatgacggctaaggcaatattcgcaatcacgccaaacaccgcagacatgcttgaagcaatgttttccggtaatgcctttaatgtcgaaacgaccgtctgttcaaactttgagacagatacataatcttggctcatcatccaagtaaatgttttagaatgcgaaaagtcattgataaatttctgcatgtccgtcacataaccagggaagcttttgacaagtccaccaacctgcgagataatcaccggtccagcagcattgacgataaacgtgatgagtccaatgaacaggagataaatgatcaggatagcgagagttctaggtattttcttggacaaaaattgaacaattggattaaagatgaaaaagagaatacccgccagcaaaatggggacaaacagtgttgatgcaaataaaataatcggctgaaataaaaacgaaacctttgttgatacatacacaatgagtaaaacaagtaatatttggaatgtccaaaaatgaactttagattttaacaaagatgctcctcctgttacgtattgatcttattaaaaaactactattcaaccccccttctgtcaactgcttcttgtttttagaacctcattttttgaaaaaaaaagaacaattggtatatcatgcactttttccagatatacattctataagcatgaaaaaaagcagacacctatgcgtctgcttgttacactctttcactgtgatcaggcatcaccgacacgatttgctggatccgcacataaaaaactgatttcgcccccgcttctatgacaatatgatccggcatgacttccttcaatttcccacggaccgtatctttcactgtttgcacaattaatctcataccgaccactttctgcaatgtttgataaacatatggatcaactaatgaaacaagctgtggacttccttgttgtgccatactacccgcccctttacttgtgtatttacccacagcgtatgcatgaacccatgtgaatgtcactcatggcaaccccacaacattaataccatattttaacatttagttcgtttttacattttttagaagtataatagattggtgctgccaacaatttaaatcatttgaagaggtgaattttcttgaaaaaactcatttgtattgttgctgtcatgctctttctatcctctgcaagctatgcgtatgcagggacaattggagatcccccagggacgccaggaaagtggtttaaaggagaagagcccattcaaaaagacgggtcaaaaccaccacttgtttttgttcatggtattaacagctcctcctacacttggtccaaccgaaacgatatggcaaagcaggctgttcagaacggatacgaaagcgcattcatagatttgcacccagatcaggacatgaaaaagaacggcaaactattagcagaaaagctcaaagaaatctatgacgcgtttggtagaaaactaatagtgattggtcatagtaaaggaggggtcgatacacaggccgccctagtgtatttcaaagcatatccctatgtggaaaaggtcattactcttggctctcctcataacgggacaccgcttgcggatctagcatatagcaaaggtgggagctggctcgcgcaaattcttggacaaaaaagcgaagcgctttattctttgcaaactggtctgatggcagcttttcgaagtgaaaccgaccagctagaggcgttccccaataaatatgtcacctactctggttcggaatggggaacatttggcggtgcgctgtatttaggcggcatgtatttaaagagctttggtacaaatgatggtgccgtcacagtaaacagcacaaaactatcctatgcaaacaatattttaacaggaaaatgggatcactattcaatcaaaaacggaacaagtatgtttcctgtgttccagcatcagctgctggcaaatgcctcgagcgctgaaaataaacataaagaggaacaagagcccgtctctactgagctcaatacagatgtttatgtgacaggtggagaaagtgaaaaggataaaacagaagcgttctatgtagaggaaggaacgaatggcttatcgatccagtggttaaatgaaaggcaggagtcgcagcccgaaatcattgccccaaatggagacgtcttaacaaatcttaagacatcggaagcttctttcccatatgaaggcgcatattcacaccatgtgaaaatcaataaacctgttcctggaaaatggacgattcaatcgaactctggaaaaagagctccttatctgctgcttgtatcttttgattcaccattaaatgaagaaattaaagaagctgcttcgaagtcaggaggtgcatcgacccattcaagcggtctaattaaacggttaagcaaatctgtggaaaccaattactttaaagacgcacaaaaggatcatccagtgaaaacaagtagctcatcagctattcaattgaaaaaagaaggtacttattccgtcacggtacaatacactggactcactaagtcagggacatctgcgtttaaccgtaccgttattcgcacattgtatgttgatcagcatggaacgattcatggagacattccatattaaacagagcgtttcatgggctgaagtgcctgctgcactttctgatccaaatcggcaattttcttcattgccagtgattcgtcaatttgtctgtaatggtggtgcccgcctggctcttcatccatttcatctgctttcttcacaatttgttggagtgtgtccttatgaaggtcgccctctggcaaatatgaatctgtatgaagcagaatcgcaagtgcaatatctttagctgcttttggttcctccccgagccgtatgagcagtttatgtgcccgctctgcacctttaatggcatgaatatcatttcgtctatatgtctcgtaatcccattctccgccggctgtataccattcatagtggccgatgtcatgcaagagtgctgctttcacagcgagatctgggttaattccagccttcattgccagcttgaatgcgtgataagcacaagcaatcgcatgggcttttcctgaacgatttaaatatttttgagcaactggatgggtgtaaacatccattaatgtaacctttctcatggaaacccctccttatctatatttttagcatcctaacatattctgaaaagaaactcaaatgttctgttatattttctatgagtctcaagattagcttatgtcaaatcagccggttttgcttgtacaagacggaaaaaagcagtcgttatgactgcttttttccatactctcgtgcatcatatacgcagcctccagctggatcatccgctataagatcgagcaaaatacatgcgacttcatctggactcttcagggtgcctgtttcatataattgctgaaaacgatcaatttgttcgaagtcctgttttgaagattttcgaatctctccctgcatatctgtatcaatcgtgcctggggaaaatgaaaacgtgttgattggatacgcctcgtcctgctgttcctcatgcaaagtcctcataaacatatcaagtcctgcctttgagctgcaatacgcactccagcctttataaggatttttcgccgctccagaagaaagatgaacgatcgttttctttccattaaacgattgagtctgtttaacaaacacatggctcagcaaaacaggaatcacaagattcagcgtataatgctgatgaagcgtatcctgtccgccttgccccacacgcttgattggtgtcaccatgccagcattattgacgaataagatgtcatcagctgctgtcagtgtttgcggcgtgagacaatcttgaagccattgggctgctgctttctcatctgtcaggtcgacctgtgtatgtgtgagcttcgaatgagaaattggtgatgcgcttcttgctgctgtgtacacatgatctccgcatgagagcagccggttcacaagtgctaggccaaatccttttgatccgcctgtaacgattgaaattcgaatgacaatctcctcccttgataaccttattttacgtagtgaaacggtatgacttcaagcaatctgcataaagaaaaacctgcctctttttaaagagacaggctatttcttttcagccttcacattcaccttcggaatcagaatgaacatcacaacgatgccaaagacgatcaagaaaccaaagatgatcggaagcagtggggatgactgcttcttgtgatcatcgccagaaggtgccgatacagcggcatctcgaaaagagatattcatctcttccatcatgtgaactgatgttttgggcgggttctcttttagatcactgaaaagctgcggagaaagagaccctcccggagttttaggaggttcagcaaaatgaatgtctgttttaactgttgatgtctttttgctttgttcgtatttcgtttgatccctcaatatacttgagttaatattgagttctttttcttgatattcattcggcttgacatttgtatccgtatcttcaccagcagcgaaagcagcaggaatgagaagaaaaagggacatgacaccaagtgccatccctttcacgaacagattaagcctcatgagtgacatcacgttcctctgttttatctttccatagctttgtcacaagagggatgaccatgaataggacagttaaaatcactaatcctatcacacccattccaaagtgatctccatttccatattggatggacaagtacacgtctgtcactggatttgtgaaatggaaattcggcatcaccaaatcaattaatggtgcgacaaagaagaaaataagcgctgttgctgccatccatccggcaatggagccgaaatggaacgccgtgcgaataaaggcggaacaagccactaatagtaaaatcgtgaaaatggaccactgaatcgcttgatcatctgcaagcttgtaaatgttcagtccgaacaagctgatcataagtccgactaatagatttaagatgccaaacagtgcacctttcaccagcatcggagctgccgcataatacgagctgaaaaagccaattaacaaactactgatcatcacaatgaccaaaatgaccactggcggtacagtctgcgttttttcttctggtacatcaccactgattttcagcggattggctaagtgattatacacatagttgctattgccttgatcacttaatgtgtttcctaaaataccttttaaatcttgctgaacaagcttcgtggaatgaacattcttgctccagttttcattcagcgtatccgctttttcttggaccgtcgtcacactctcttcaatgttattcgtataatccgccacccctttttggcggtcggttaacgaactcatattttcagaaagtcgaagcacttcctgaccaattgaatcctgcgcactgacaacaattgaactgcctgcaaggtctgccgtatacactacatctccttgatcagccatttgttccgcaacattgtccgcactttcagaaattgtgtttaattcctgttccatgcttgcctgctgagtcgaaatgtattctgcatagccatctgaaaacttctgcatctcatcaataaaagtagacacatcctcgtttgacgtcagcatttgttttttgagcgtatcccagttttctgtttcctcttttttgatggagaggatggactggatattctcttcttttgcgtcatataaagaagagttattagatggttgatagacatttgcgatcatcagctctagctgagagagctgattagaatactccattaattttttagttctgattgattttgtttcaaattttttctcaaaaagattgtccttaaatgcttcaccaatcggtgagtttctgcgcttcagctcttttactttgcttaaaatagcggattcctgacttttgatttcatttggaatcacattatatcgatcttgtaaccatagaatcatcttttcaagtttatctacttttttcgtcagactctcaagctctttactcatttgacttactttgtctttcaattcgtcattatgagcagccgctttttcttgaattttctttttcacttcatctaagcgagttgatagtgcttttaggtcatcctgcgatgaatccttgctgccggtatctggctgagcaggattttcaacgttctctccttcttccccatcttcggtcgaaggcggtgtctcctgttctcctaattgatccgccaggtcgttcatttctattgaaatttgagagagctcatttgtttcttcatctaggttaatcccaatctcttctgggttttcattatcttgatctgattgcccgtcatcttcagaatcaactggcggctcaggctcgttcatcaactcttgcctttttgccaatagattcgtttgcaaggctgatatcttatttcgatagtcttctaaataacggtcttcatagtttttaattagttccttctgagacgctatcacaagttccgttaaccccgttgattgcttaggaatagcgtcctctcttgacttttgaacagattggatggcgctgtccgttgtgtttagctgactttgtactccgttgatatctgttttgagtccacccatttgatcactaaagctgcgggcattttggttttggatatcagcgagctgtttgagtccctgctggatttgtttttggtttgtcgattgcgctttgatcaagaggtccttttgtttgtcttgatactgctggtattgatcgactacttttacaaagtcctttaactggttctttgcttcttctgttgtagtcagaccgtctttatactgtttctgcgagtcagtcatcgcattttttaattcttctatttgtttcttctgctgctgaacggcgtctgatagtttgtttgaattcggcttatagaagttatacattgtgttttggaattcgacttctttcccgacaatatgttcaaactcttctctgacattgccgatttcctgtgatacaaaactccagtataacgtcgacatctgttcattcattttcttttgcgcattttccagctctctttgcactttctctttattgactgaattgagctgatcttgaatggaaaattgaatggatgccttttcaggatggtctttatcatagctcagcacatttttagagaaatcagacggaatatagaggacagcgtcatactttctgcttttcagtccattttctgccgcactccgattcactacggtccatgtataatctggacgctctgataatgcggcgacaacatcctgcccgaagcgagcggtgttttcactttcgctcgctcccatatcctcattgaccacagcaatattacgtgtggcattctttttctgttttgccgggtcatctccaatgaggtggaaaaataaaaccggcagaaccagaatcaatatcatcgtcgatacgattttgatggagcttttttgctgctctgtcattgaacactcttcctttctaccgcacataaaggaacctggattttcttctctttcccgttttcaaccaaatacccgaagcctggctgaatatctggttcttgtcttgcatacggaagcggtatgatgttttgctctgattttttcatgagtaacatagcatgacgaacttgtttgatttcatttgtgagtgcatcatagcctttactgaattcggtatgatttcctgacgcaatcaggctaaagcctaggtgtgcatatgacttcatgaaatcagccaattgatcttgaagacgcgggtcgattgtctgctgaaaacgcgtaatgccatcaatcacaagcacaatttgagagaacgacaactgatcagtctctccccggcgcacagcttcgacgtacatctcttcacgcaccttgaataaacgatctatttcctcggcccattcggtgatatcatcctttgtttcaagataatcaatgttctcttcttttgcataatgagagagcccccgatcaatcgaatcaaagacggccagcttctcaggttttgctgctaatagctgatcaagcatcagttttgtcacatttgttttccctcgctgcgtttgaccgatgatgaggcagtgtttattcttcttcaagtcaaagtaaacaggagcaacagattcctcatctagtccgactggaatgtcatacggctgtttttgttcttctaagcgactctctagctcccaaatggttagtttatcaggaagcattggtacaggttttggtttttcagctgattcaaagcgatcatgaagaagctggatctcttgtttcaaatgctcaaacagctcaagatcgttctctccttcaactggcaggaacatttgtgcaaagtaaagctcttctttgttgataatgactcgtcctggaatcggctctaagctaaatttcggtctgccaataatcgagtacgcctctccttgatccattaagtaatggacgacctttgttttcaagttgttcataagagattgacggactgcgtttacccgagtcgctgtaatcaagaagtaaattcctaatgattgcccatcacggctcagctggataaattcagattcaagttcatgcatttcgtctttgacaatgtcaaagttgtcaatcacgatgaaaatgaatgggagctttttctcatttaaggcgttgtacattttgatatgactcatttcttgctgtctgaataatcgcttgcggtattcaacctcttcccgcagacgcgtcatcgacttttgaatctttctcatttgatccattaagaaataatccgccgtgtgcggcagtttggctaacggaagcaatgttccgtttccaaagtcataaatatacgcatgccattcttccggtgaatatctctccgcaaagctcatgagcagtgttgttgcagcaagcgattttccgtagccggaggaaccaaagatcccaatgtttccatcctccatcatttgataagaaagtggatgctggctttgttgatctggctcatcgacaagcgcaaaatggaagacatgctcttcacttgacgcgtaacgtgattttggaatccgttcttcgagcggtggaagccatggacttgggagcttctcaatcccaagctcctgctgcatacgttctatttcatccacaacagcagaaatctccgacactgtctcttttttcacagccggctctgtgctcacccctgataacggaataagtccagtatcagtcacaatggcaatatcatcttctgatccgtagccatcttccatatacggcgcaccgctccaagctgattggaacaattcatagatttcattgttccccacttgtaggtagccgcggcctgtaacggtaatggacgccgcatcactatttttcaatatttccttactgtctgacgcatcttgtacttttagtgcgaccttaaagcgggagttactccaaatctgatcatcgatgactccgcctggcttctgggtagccaaaatgagatgaaccccgaggcttcggccgatacgcgcagcactgacaagctctctaataaagtccggctcttcactttttaattctgcaaactcatcagagattaagaataaatgaggcattgcctgttcagcctttttctccttatagagcttcgtataatcattgatgtgattcacatgatattgatcaaacaagcgttgtcttttcttcaattcacttttaattgaggcaagcgctctttcactaaaattcttactgccttcaatattggtgatcgtgccaagtaaatgaggaatattccggaacggctgcgccattccgcctcctttatagtcaattaataggaaagcgacttcatgcggatgaaagtgtacagcgagcgataaaatgtacgtctgtaaaaattcacttttccctgaccctgttgttcccgccaacaggccgtgtggaccgtgtgctttttcgtgcaagttcagatccacaatgtcatttttccctttataaccgattggcacagagagtgatttagccgtttctgatgtgagccatttttcacgaataccaatctcgtctacctgtttggcatgaaaaagatcaaggaaggaaaccgtttcaggaatcgaattggtcatgccaacttgatgatctaatgttctcagcgttctggcaaacagctcattgtccacgcgctcatgtgtatcaagctgaaatggaattcggacggctttcttgtgctgaatgagaatatctccttcttcttcgttaatataacggacaagcgtcgagatattttcagctaagctttcctttgtttcagcagcaaaaataatggagatgccaaggtccgttcggctgccttctaaatattctaaaatcacatgttcagcaatgagctcatgatttgtcacgataaacacaaagtgaggcgtaaagatcttcttctctttttcttcttctagatcacgctcacgtaaaatctcataaatcgaggacaacagctggtcgcgtgtttgttcgttataaataaaccctttgccgtatgtatgaggcagctggaaatgtggaagccatttcatccattcccaattctcatactcctgctcatgaaaaataaacacaaatcttaaatcatgatagctgtgcgagaaggcaagctgtccgacaagctgatgaagctcctttttcacaatggctggctttccaatcaatccagttgggccatcggcaaggccgaatgtgatgggtacatccttcacttcacgatagacctgttgcatatgctgcgtttgttccattaaatcatcaatgtcacgattggccatatcgccgccgctcatcgatagttcatagcttgatgggactgcgcccgtcccaagacgcagctgcaagaaatcatcactcacaagtgttttttcccaaattcggccgctaatttctgatgttaaatacttcatttgttcaaatgacggataatgatacgtcaaaatatattgctggcggtcgtagagctcttgcagctcttttcgtttattttctaagtaaagagaatagactcgctgtcgtttctcttcccgtcttttgcgttgtgatttctctttaaagtattgaacagacgatgtgattaacgtcatgataaacatcgccatcgacacgacaataaagatcccacggggctggatcagagcgacaattcccattacgagaagcatcacaagcggcgggaggacaacaagccaaagccctctgctgttattttcactttcctgcgaaggaaaactaaaggaaacccggtcatctggcagatcataaattaaacgcggtgttcgtctatataaaggatatttttgttttgtttctgtgctaggtgctcttgttttttccaaacgtgtttgaaatggttcatatgcagtcacctgcaataaatcatcatctttcaatgtcaccgttagaaaattccagaacagctcatctccagcatcaattgtctctggaccgtgaatttttttcccgttcacataaatcgtttcgtcctgaggcatgacataccaagttccttcgattttctccaaagtaaactggctcgcatcttgaaacatggaatgcgcttgttctttccacacatcgatatcatctttgttctcacgtgaaaaagacagctcgactctatttcctaggtaataaatgtgttgatcatgatgtgcttccattaaaataagtgtcagtgtaccaagcttatacggttcatgtagaagtaatgtgcctttcttctcttcaccctgataaatggaaaagccatcattcggttcatcgggagataaacggatgatcccttcatcaaacgaaagtgaagggattgtcaccgtatgctctatttcaggtccaatcacagcttctcgattgaactgctcgtctaaacggacggtttgataatcctcctcataaaatacccaaagaagactcaaacgctccacctcctcatgggacagcaccaactgtcagttgtatcgaaagaattattttttctcatcttttttcgtctgagaggttttctttttcgcttcagattctttctcttttttctcttgatcggcttttgactgctctttttgttcagctgtttcatctgtttggcttgcgcccgaggagtcattggtgcttgtctccgttgtttctttttcttcatatttcgccatttccttaataattggatctagctgtttttgtttttcttctgcagaaagactgtcatcgttttgaatgtcattgcggtaggcgacgagtgctgtaaatatgtaccggtcgtctccaagtacacgtgcaatatcaagtgcttccttgctattgccttgtccaatatgaatccagaaaaggaaatattgcggatcagtctgtaatgtgtatgtatctgtgatttcttttttatgctgatcgagtaacagattgccttgatttgtttgtacatacgaaatggccagttcatattgaagagagaccggcatttgattggctgaatatttttctaacgtatccaccacttggctgtactgtttgttgagataatatttgtttgcctcgacatacgcttcttgtttcggcatcgcaaaaaagaaggtgtaaatggtgtacaccaaagcagggattaataggacaagcagacctagtccgacatatcgttcgaccttccatttctttttcggaatggtcaatagcgttttctctttcgtttcaatcgcttcgatcttttgctgaatcagggcagacaattcttccaaagactgcgtttcgctgatttcttttgccagttcagatagtttcagcgtttcgctgtaagccacatattcttgaaactgatattcatggtccaccactcgaagaatgacggctttgacttcttttaataaacgatgttcctctgtttcatatggcgggatgctttctttgacgccgtaatgcaaaaatgcaggagctaagccttgatgaaaaacaatgttttcaggagaaacaataggatgcagccgcttcacgtcgtgtttgcaaactgcatcgacaagctggtatgaaaaaatccatttgcttttttcatccttcgcatggatgaaacgaaattcctgataggcaggaggcggttgaatagaaatgatgacttcatcttcagtaagttgaatctcttttttgaatgaaggattgatgtctttgatcggtgccgcttctaaaccgtctaagagtttaatggtctctctttgaaaaatgaaactgtaggtgccgccctcttttttcatcactgcttctaattgttcttctaaataggaactctttttatctgccatttacaaaagtcctttcatagtatttccagcctgtctcctgtggtgattccacagtctgacagcttatattcgcctgaaaacacagctttcttattgacaactcgcacccagccgccttctcgcttaggaagtgagatttgttttgcctgccaggcgatatggatgacttgtttaatatgtaaataatttgatagtctcaaatcaaacacactgccatcataattttttaagtcgatggtaatatcgatatacacaaatttccacctcacaaaatagaaagagcgccggcatccattgacagactcggcgctttttctgcttttcacacttagaaaggaaatccctttgattagccgcggatttggctggcgatgtcttggtcagtgctttcaagtgtatttgccgtttgatcaagctgattgctgacatctgttaatagatcagacattttgatgaatgaaggctttaactgctcgtattgatcagcaaatgcttcactagaagcaccttcccacattccttttaaatctgagatcattctatttagacgatcaacttggtttaacacttcttgactttcaacaccatattgcttagcggtcgctcttagttcttctggggttacgcgaataattcctgacatattcctcattacctcccgtgcatagccgccatataatgggctaatccacttattttttgacgttattattataaaaacagaaatgatacacagtcaaacaaatctgtttttattttacaaaatgagtctatagaattactgtattttcgctttttatctattatttaacatttttttggtcatatattctcaataagtgtagacacacttcactgaatctttccgcctattgatttattactacgttattattgtactatttctttttcgccttctttcagcatgatacgctcgcttctcatagcgatctcttttttaaatttatggcattttgttattgatttacgtaccgttttctcttcataatgtaagtacgtgaaatattcgaaaaagcaggggtttttatgacaaaaaagacagatccatttaagtatagtcttgatcgtttagaggatgtggcagaccaaattagtgatgtgctcaattgccctattactatagaagatacgcatcatcgattgctggcttatagcacacataatgattttactgatcccgccagaacttcaaccattatctcccgccgtgtaccggaaaaagtcattaatcggctttggaaagacggcatcattcctacactccttaaaacagacgaaccgcttcgtgtccctcaaattgcagaggtgggtttatctagcagggtggccatttcaatctggaaggacaaagaagtactcggatttatctgggcgattgaatccacacagcctttttcagaagaagacatggaccttctgaagatggcagcacatgctgttaaaaacaaattacttaacttacaaattcgcaaaacgaaaacagaagaacgcaatcaggagcttttttggaagatgctcacaggtcatattcatgaaaaggatgagatgctcgacctatttttaagactcggcatcagatgtccagacacgtatgccatcatcatcttccgacttcgtgatgaactcacagaggacacagaaaaaaagctatcttatctgcttgaaacaacgcagcaagtccaagtgttgttaacgactgttgattttcacgaattcattattcttgtctcaccaaaaacagagcacccgctgcaggatattaaacaattcacaagcggcatgctgcagcagctgtctgaccgttatcatatccatcacgttcaagcggcgattggtggaatttacgataacatctctcatattcagccatcctataaagaagcactcgctgtattaaaaacaaaagaacgcttccctgttgaaaccgaacgtttacacagtttttctgaactcggtatttatcaatatttagatgttctcgctgaaaaacgaaggggctcatcttactccagttactctttatcaaagctggaagattacgacctgaggcatcattccaacctagttgaaacccttgaacggtttattgactgtgacagcaatgccaatattgcggcaaagcaattaaacatccacatcaatacattgaattacagattaaaacgcattactgacattgcagaaatcgatttaaaaaacatgaatgagaaaatgaccatataccttgatatgaagctaaaaaacgtccatttgtgaaatttcacaaagaggcgtttttttattttttatttcaaccgaagcattttttaaacattcaggatacactagacatacaatatgaatagataagcatgggaggaataaacatgatcatcggcattccgaaagagattaagaacaatgaaaaccgagtggcattaacaccaggagcagcttctcaattactttcagctggacatcagattttgattgaaacaaacgctggttttggaagcggattcactgatgacgattatgtatctgttggtgcagaaattcttgatcaagcgaaagatgtgtgggcatcttctgatatgatcatgaaggtaaaagaaccattacctgaggaatattcatttttcagagaaggactcatcttatttacgtacctgcatcttgcggcagagccctccttggctgaagctttaaaacaaaaaggcgtcacagctattgcttatgaaacagtaacggacggaaaatcactccctctcttaacacctatgtctgaagtggcaggcagaatggccgctcaaatcggtgcacaatttttagaaaaaccaaaaggcggtaaaggcatcttactcgcaggcgtaccaggggtatcaagagggaaggtcacaattataggcggcggtgttgttggaacaaacgcagcgaaaatggcgattggacttggcgcagatgtcactctgattgacgtaaacgcagaacgcttacgtcagctggacgatcaatttggtcatcaaatgaaaacgttaatgtctaaccctgtcaacatcgccgattcagtcagtgaggccgaccttctcatttgtgcggtattgatcccaggtgccaaagcaccgacgcttgtgacggaagaaatggtgaagcaaatgaagcccggttccgtcatcgtagacgtagccattgaccaaggcggcattgtcgaaacaatcgatcatatcacaacacatgatcaacctacttatgaaaaacacggtattttacattatgctgtcgccaatatgcctggagccgttccacggacatcgactgttgctttaacaaatgtcaccgttccctacgcactgcaaattgctaataaaggcgctgcaaaagccattcaagaaaacaaagccatcgcagaaggtatcaatgtcatgaacggacatatcacatatgaagctgtcgctcgtgatctcggctatgattatgtaccagttcatcaagcgatcgatgcgtcttctatgacagaagcttaatacagacccgcccttttgatgggcgggttttattgttaaccaatattaaaaacaggttgacaaataacctccatccccttaatctatttgtacagataagacagggggaaacatcatgcaacagaaaacaagaaccgctgattttgtgctagtcggaatgtttgctgcactcatggcgattggagccaatatcacatccattgtgccgtttttgcaggtcggcggaattccacttacgatgcagccgtttttttgtgtacttgctggtcttttgctcggtagacggcttggtgcattagcgatgattgtatatgccttggttggaattgctggcgcacctgtattcgcacagttctcagcaggctttggagtgattttaggcaaaagcggtggttttgtcttatcgtatattcctgctgcctggctagctggattcattttagaaaaaagaaaaaatcctggctttggccgctttttgcttgcagctattgcaggtacgaccgtcatgtatatgatcggaacgacttatacgtacctcgcattaaatgtgtggctgaatgcacctatttcctatcaaaccacgtggttctttatgatctggtttatggtgaaagactacgcattgacgatattgcttgcaatgctggcacctaaaatttatcgctctgtttcaaaagccacgtcctttcgaaaacaacaagccgcatcataattgcagacatcatctacaagtcgcatagaaaagagcctgtcttcattcaggctcttttttcatcattattccgcgtattggtcgatgattccttctagcatcccttcaagtacttctacatcttcaagatctgatggactgaagcggtagcgcacaagctgttctccatcatgatacatctcctcaagccaccctctgagtcctcttgctctgcggtcgacttcgaaaacaatgtctaacccgccttcatctatcagaaaaatcagctctaactcatcaagcatataacgatagtcgtctgatgtcggaataaactcaaattcttgaacaaatggcagacgacgctgaaagtaaggtgcttgttcacagtccgcttcgttcaggtggaagccaaggtttctagtggcctccagtacatttctcacccaaggatgtgcttcaacgaaaatgcggtcatagtcagatttatcgattcctccttggatatcaaggtctgtcattactgcaatttctacttttccgatcgtcatcggggtatcgataggaagaataaatgaaaacggaaattcatgcttttctccaggctgggtgataaaagaatccgtcacccgtaaagtaaagatatttacatattttctatgctcttcatcatctttcacaatcacatattgtgtttgaatcttgacattgatatagcggatgtcctgagagattttcccgccctttacatggacagttccccttacctcttgtcctggataataggcgtttttctccaaaatggtatctactttcgctgcaccaatcccagcacttgccgctagctttttaaaaaatgacatctctcatcttccccttttcatttttatcagcatatatacgtaagaaagagaaagaaagattcatttaattcatactttagacctaattatttttcaccttcagaaagtgaacaaatggataaaacatcacaaaaaaagcttatagaaaaaacaatgttttctctacaagctttcatgttaaagaataattgccgcaagccagccgaagaggacaagcggaacattataaaatacgaaggttggaacacaagtaccccaaatgtggtgatgctgtccatccatattcaatccagatgtcggtccaagcgtactgtcacttgcaggtgaacctgcatcgccaacagccgcagctgaaccaataatagcaatggtggctagtgggctaaatcctaagtgcatacataacggaacaaaaatggttgtaatgattggaatcgtcgcaaaggatgaaccgatccccattgtcacaagtaaaccaactaatagcattaaaatggccgcaacgctttgattgtttccaatgaactgagaagatgctttcactagttgttcaatatctcctgttttcgttaatacgttggcaaatccagccgctacaagcatgacaaagccgataaatgccatcatattcataccggaagtaatcagcgcatccgcttcatctcgtttcatcatgcctgtggcaaacagaacaagaagacctgccagtgcaccgaagatcattccttccacaccaaggctttgagataaataaagctggacaataagtgagacaaggatagccagcactgcaagcaataagctctttttcgtataagctgatttttctacgtccgtgatatctcgatcctcatatacccttggtttccgatacacgaaaagtgaaacaagcagcccgagcaccatgccccctacaggaattagcatggctagtggaacatctgataattgtacagttaatcctgcctctttcatgttatcacgaagcattccgtgaaaaatctgtccaaaaccgactggaagtaaaatatatggtgcagtgagtccgaaggtcatgacacatgctagcagtctgcggtcaatttgaagctcgttaaacacttttaataatggcggaattaagaccggaataaaggcaatgtgaaccggaacgacgttttgtgaaaaacacgatacgatcaaaatcacaagaatgatcagtacttttgataatgtttttcttcttgagtcgccttcttttcctaaaagcttcactgctccttcaaccatggcatctggaaggcctgttttcgtcagcgccgcagcaaatgctcctaaaagtgcataactaatcgccactgtcgcatttcctccgagcccatcagtaaaggcttcaactgttcctccaaggcctaatccacctgcaagtccgccagctaaagcaccaagtgcgagggcaatgaccacattgacccgcagcaagcttaatatcaacattaaaagaaccgctatcacaactgcattcatgatgaaacctccgaaatcctttagtttactaatgtagtagataattaaagtaccaacgtatgttaccatagaaaattttcttcgtcaaatggcgtatgacctacataaaaaaggccctgccagttggcagagcctcatcctttatttctttccttcaaatcgttccacaaatgtggccaatgaccgcaccatcacacctgtcgctcctgttggcccaaagcatgaaggcttttctgttgtagctgttcctgcaatatccaagtgaacccaaggcgtatcctcagcgaattcaccaatgaatgcacctgccatgatcgcatgtccatcacggcctggtgagttattgagatccgccattttgctgtttcgtacgcgctttttatctttttcggtgattggcagctgccaaatcatttcaccgcattcttctgatgcctctttaaactgggcatacagttcatcgttatttgtcatgacgcctgttgtctcatttccaagtgccacaatgactccgcctgttaatgtcgccacgtctataagaacagaggcaccgtgctgcttcgcatatgtcaccccatctgctaaaacaagacgaccctctgcatccgtattcagcacttcgattgttttaccgctaagcgacacaatgacgtcatccggtttcatagcatcagccgagatcatattatcggttgaggcaatgacagcaatgacatttttttctgggcgcagttcaccgatgatttccatggcacctaaaacagaggctgagccgcccatatcagttttcattccaaccataccggctcttggctttaatgaatagccaccagtatcatacgtgatgcctttaccgacaagcccaatcacgtccgtccagtcttccttgccttgatatttcagaacgatgagctttggtggttctgttgagcctctattgacagctagaatcccgcccatcccgagctcttccatttgttctttatctaaaatttcaatctcaaattcgtatttatacgcaagctctgccgcgtacgaagccagatcagaggatgtgagcatattcggcggcatattcacaagggtacgggctgaattgacggactgtccgtagacttcgcccactttcagacttgcctgaatttcagctgtatcatgatccgtcgttgcataaacaaactcgatgaagcgatccggttcatttgttttatgtttaaaatcttgtaattcatatgtagctaaaaggcagctttcagaaagggcatgggctgcatcttgggcaggcagatcctttccaataaacgtatccagcaagacagaaaccgcttgctttttatcttgatgaagctttttaaataaatgggcaaacgcttcttttgcctcttcaaacgtgtaatctgattccttcccaagcccgacaaaataaatgcgtttgatgcctgtttcaggggacgggaaaaacttcgaaagctgatttcgtttagatgagatatcgccttcttttaataattcagtgattcgtccttcaagtaattcatccatttcttttgcttttcctgataattggctcttttgaaaaagtccaatcgccagtgtatctttatgttgccattcatttgtcgagaaaaacatatttatcacacgctccttcaatgaactccatttttcacattggaacttctattatatcaaaatttgcgggtctatacgatcattgccaagctgtcttttcttgatgaacatttatattttcacacgcggaagggcatcatgaaaaagcgatgaaaacttgtacagcccccctgcactctcctcgttccacatctactttctttaatgttataattgaacatggacttggcagccttttgaatctgctatcattttttcatcatactagggtacacagtccatcattttgcacgatattttttcttacagagaggatgtttcttgttcatgagcgtactgacgaattttccgctgcttgccagccttgcagccatcttttttgctcaatttgtaaaagtaccgattcaatttatcatttctagacgactagattggtcgctcattacaagcacaggcggaatgccaagttcacactccgcagccgtaacagcactctcaacagcagtggctttagagcacgggctaaatacatcgatctttgcgatttccgccatctttgcgattattaccatgttcgatgcgacaggtgtgcgcagacaggcaggagaacaggcgactgtactgaacaagctggtaacagattttaaccgatttgtttctgaagcaaagaatttcccgagtgcggaagaaaaagaaaagcaaaagaaattgaaagagcttcttggtcataagccgattgaagtcttctttggcggcttaacagggatcttactgacactcatcttagattattacttcatgtagaagcgaaaaaagctttggacctaaaacttgtccaaagctttttttattctttattggcttgaaactgctgacggaatacttgcatggattttgcttcattcagctggtttaagtctttttccgttaacgttccttctccctttttgatgatatacacatcgagtacttttttaccccattctctatacacatcatctaccgtttcatagtataaatccagcttatgacctttaatagcttttcccgtatctgcgaccactccgtagccgtagtttgggataaagagcaccgttccaattggaaagactgatgggtcagcagccacagttgaatataaatcacgtttcactttgacgcctgaatatgtaatgccatatgcatggtgttccttcgttttacctgttgattcaacacctgctgtatagcctgtggcaacaaccttttgcttcgggtaatcgttccaattaaacgcttcttcgagagaaatagcccgcaagtcatcgcttttgagtgccatcgtttctcttttttgctgttggaaaaaagaagatacttgcttgccaggatcagtctctttcacccaggcagctacatcacttggttcaacgccagatatgcccgtaaagcttgtcaaaagagcaagcataaaaagggctgtcatgaacaatcgtttcatccatgttttcatctttatttgtcactcctctacccatctatttgtttccaaacgaaatggaaactatgcaaaggagaaacaaaaaaactcacttgcctatccacaagtgagttaaaacatttgatatcctctttttcgaagtgcattaatgacaaaacctgatgcaattgcaccaatcagaccacttaacaagattatgatatcagccgcagcgagagagactatgcggtcccctattcctgaaaaagcgatgcccggttctctgacataagcgatcatcttttgattattgataatgaaaaggcatacaattggatataaaatagccataatccatgacattctcagcagcatattgagcaaaaagccaatgccgaagaataacacgaaaaataaaataacggaaataataacgactggtaaactgatcacttcatctccacccccaaatatcccatcattagtttaacttggaaatagagatgaagtcaatcaatggaaaaagcagatggattaaagcttctttcctgtccctttacattcctcacaggtttcagatccgccgagcaatagctgaaaatatcctttccccgaacaatattgacaagtagactttttttcttttgtatgtgcattcatattgttcactcccttaatctaaattttctgataattcatcataccatactttactgccaatgaccaagtaagaaaatatgccaaaaaaaaaaaacgtgtatcacgaggatacacgtttttgtctatatcggtttagaagaacttgaattttccttttttcagaacaagtcctggtccgccaaccatgaataaagaacggttgtcgatgattttcttcattgctgaagcttttgttccttgaagttttttaccaaacgcaacacctacagcgtcgtgttcaccaagagaagcaactgttcctttgatgtctggcttaaagctttcaagagaaccacctttcactaatgctgcaaggtttttcgctactgtttcaccttgctgcatcgcgatttgtgcagttggtgggtatggacggttgatttcttcattgatgatcaatgaacagtcaccgatgatgaatacatcatcattttctggtacacgaagatctggagatacttttacgcggccgcgcatgttttcaaatccagcttcttcaacgattgggttaccgcgtacaccagcagcccaaacaacagtttcagctttgatttcttcagtatcatcgtcttttccaacaatgatgccttcaggcgtacattctttgatcgctgtaccaattttgaactcaacgccttttccttgaaggtagttcattgcatagtcgatcaattcaggatcgaatcctggaagagctgttggtgcagcttctacacagatgatgcgcacgtctttttgatcaatatcatactctttgcaaagctcaggcacacggtttccaagctcaccaaggaactcaatacctgtgaagcccgcaccgccgacaacgattgtcaagcgctctggacgtttttcagcttccgtattatatgtcgcaaattgaagctcaatgtgctcacgaagctgacgagcagagttgatgttagagattgagaatgcatattctttcagtcctgcaataccaaatgtttcaggaacagcaccaagcgcaacaacaaggtagtcgtaagaaagttcgccatctgatgtcacaactttcttctcttccttattaatgctttcaactgttgcttgtacaaagttgacacgggaactgttaatcacatctttgatttgataacgacagcggtcatgatgaagtgtacctgcacttgcttcatgtaaccatgttgtttcgtaatgataattatgcttgttcacaagagtaatgtccgcatcatttgtgccaagctgttttgttaatcttgttacagtcattaatccgccataacctgcacctaatacaacgattttcggtttattcactggaatcacatccaccttttttaaatttgctgtaaaacggataaaagaattacatatcgttattctcaaccgctttccggcattttatgaaatttaaacaaaaaaataagtatgtgaaaatctgaactttcacctacataaaacgaaagcatttgaccgtatccgacaaaaattcataaaaaattaatatttagttcccttaacaataatagcgagttctgatccaattttcaaggctttaaactgaaaatccttatgataaacggtctttctcactttttcctctttttcaaagcttcggcatcaaaaaacgacaagtttttcaaaacaagtcaaacgacgatgtgtggtatgatatgatatagtgataacaattttcatttgggaggattaaaggaatgcaagaagattctaaggtatatgacattaccgttatcgggggcggcccagtaggattgtttactgcgttttacggaggcatgagacaggcaagtgtgaaaattattgagagccttcctcagctcggcggtcaattatccgctctttaccctgaaaaatacatttatgatgtggctggttttccaaaaatccgcgcacaagaattaattgataacttaaaggaacaaatggataaatttgatcaaaccatttgcttagagcaagcagttgaaacggttgaaaaacaggcagatgggatctttaaacttgtgacaaatcaagagattcattattctaaaacgatcatcatcacagctggtaacggggcattccaaccgagaaagcttgagctaagtgcagcagaatcatttgaaggaagcaacctgcattacttcattaatgacttgaaccaatttgccggcagacgtgtcgctgttcttggcggcggagactctgcggtggactgggcactgatgcttgaaccaatcgcaaaagaggtatccattattcaccgccgcgataaattccgcgcacatgagcacagtgtagaaaacctgcacaactcaaaagtcaatgtcgtgacgccatttgtcccaacggagctcgttggtgaagaccgcattgaacagattgtgctagaagaagtcaaaggcgacaaaaaacaagtgcttgatgtggacgatgtgatcgtcaacttcggttttgtttcctccctcggacccattaagcaatggggtcttgaaatcgaaaagaactcgatcgttgtgaaatccacaatggaaacaaacattgaaggcttctatgcggcaggagacatctgtacgtatgaaggaaaggtcaaattgattgccagcggttttggtgaagcaccaacggctgtcaacaatgcgaaagcctacatggacccgaaagcccgtgtacagcctcttcattccacaagcttatttgaaaacaaataagcgagatcaaaaaaaggagttcccactagcggaactcctttttcgtttatttaaaaaccccaatataggcattcgccattccaagtaccattgcagcaagcagcaccacaacaatccctgccacaaccaaaatcacccgatccttcacacgttcctttttcggaagcggcttctcaatcccgcaagctggacacgttttagaacgatacggaatcagttcatgacagttcctgcaattgatttgttcactcaaacctcagcaacctcttttctacctacagtttatgtttggttctcatgatactcttttcgggtggaaatagccagttgtgagagcaagctgtaacaaaattgagcgatttataaatggttgaagtgagaatgaaggtttcatctgatcaaccgatataggaaaagaagaagatcttaatgaaggataggtggaaagatgttaaaacgtttcataatcagtttgggcttattactgatgattggtggctcagttgaactgtttgcaaaagactataataaacattatgctcagttcgcagcaggattgaatattgatgttgatcaactagaaccatttttaaatcgtgtgtccacttcaattttagattctggattgagtgatcaagaaatcaaacagatactctccaaagttcaaaaaatgaatcaaaacaatgaaacggaaaaaatgggtacatttgaagtggtgtaccacgaaaaaccagcaaagattaaaatggtgattgaagtccatgtggaagatgacaataaagaagtggtcatctatatgtttagcacccaagagctggtggatgtcttggataaagagctgttgaaaatagaagaagcaatatagaaagagacactgaatgagtgtctctttctttatggttggttttcttcatcaaaaaagcctcctcgatcgtgttgtttacaaaaacaaacgaacaagaaggcttatcttaattcacgatcagttgttaacactcttccggcgtaccggtattcgtcgctgttctgaaagaagaaccgcatccgcatgaagcaatcgcgttcggattatcgatggtgaaaccgccgcccattagtgattgtttgaaatcaatgatggtgccgttcatgatatcaaggctttcggagtcgacaaggacctttatgccctgctgttcgaactgcgtgtctttctcagaaacttcatggtcaaagcccatgccgtatgaaagaccgctgcatccgccgccttttacgcccactcgtaggaacgcattttcttcttcatgttctttcatcatatctttaatctgcagtgcagcagcttctgtaatggttactggtgtactcatgatcatccctccttttgactggatgtttcttttcaattataaacgtgatggggtcttttctcaaataaatggtttacagataaaaggtgccgtcacaaatcgtttcagcaggtcctgtcataagcacatgctcattgtctttccagcgaatgatgagatctccgccagctaagtgaaccgtcatgtctgtttctcttttcgcctgtccattcacaatcgtggatacggcagccgcacaagctcctgttccgcaggcttgagtaatgccagatcctctttcccacacgcgaaaatgcagctctgtttcactcaccacttctacaaattctacattgacgccttctggaaacatgtcgtgtttttcgatgattggcccaattgtatcaagcggtgccttttcaatgtcctccagataaaaaacgatgtgcggatttcccattgaaacagccgttccatttaaggtcgtcgtgccaaaatcaagcggttcattaatcgttgtgcttgctggttcgccaagcatcggcatcgcttctttttcaaaacgaggctttcccatatctactgtcactaaatgtacgtggccatcctgcacatgaacggtcgcttcaacgagtcctgacaatgtctcaatctggaacgttgtgtctgttacgatttgatgctcatacacatatttagccacgcagcgcagaccgttaccgcagtttttcccctctgaaccatcattgttaaaaatgcgcattttcacaggtgcaacatctgatgggcaaataagaatcattccgtctgaaccgattcctgtgtaaacagaagaaacccggatcgcgatctctgatagctgctcttctggaagctgttccttcatttgattgacgtatatataattatttcctaacccgtgcattttcgtgaattgaaatgatgtcatgagcttcctccaaaaatgttgtttctttatagtataaaaggagtcggttcaggagacaatcttatcatcccccgtttttcatacataaaagctctttgctgccatggcaaggggcttttattatgcatatgcctcattttctctcgtgtgatgcttcattttgatgatattttattagcataacatattggatgcgctttctatcgattctccttaaaaatggaaaataaaaatatgaaaaaaatgcacctcatgacccatgtggtgcatttaaaacatctcattttcctctataaaagcataaatacgctcgactagctgctctgcattttctccggaaacaaattctccattcacgagtgcaaatggggagtccatacatttgccgcaatagcttaaacagccgtattccataacgtctaggtttgggtctttatcaagcttctcttttgcttcttgagacccttgcgcaagattacttacacaaaattcgatcagtgggaacactttgcttcacctcacattgctttaccatcctaccgaaattccttctattagtcaaaacatgagcttcacctgtatcgttacgcctattcctcgtaaaatgttttactatttaggactaactaatgaatatgtaggttattttgaaacaattattgtggtttcacagtaaattcgatataattttatttggtattttaacttaaagttttttagtataagtgtttttcaatgtctacggggaaaaggagaatcgtcatgaaaaatttagtcttgatcggcggaggttacgggaatatgcgggttctccaccgcttattgccaaatcaattacctgatgatgttaccatcacattaattgatcgaaatccttaccactgtttaaaaacagaatattatgcactcgctgctggaacgatctctgatcatcacattcgagtatcatttccagagcatccgaagctggatattcaatatggggaagtagaaaaaattgatattgaaaacaaacagatcttattcagcgaccgtgaacccattccttatgacgacacggtgattgggctcggctgtgaggacaagtatcataatgtccctggtgcgaaagaacatacatacagcattcaaaccattgatcagtcaagacatacgtataacaaattaaacaatttgagtgcaggtgcaacggttggcatcgtcggtgctggacttagcggggtagagctagccagtgaattaagagaaagtcgtgctgatttaaacattattctttttgaccgcggagagctgattctatcaagcttcccaaaaagattaagtttatatgtgcaaaagtggtttgaagaaaatgacgtaaagatcattaactgtgcgaatattacgaaggttgaagaaggtattgtttataaccatgatgatgccattgaagcagaggtcatcgtatggacagcaggcattcagccaagcaaagtgatacgagagatggatgttgaaaaagacgtacaaggccgcgtcgtattaacacctcatcacaatctccctggagatgagcacgtctatgtcgtgggtgattgcgcaagtcttccgcatgctccaagtgcacagcttgccgaggcgcaggcagaacaaattgtccaatctctgcaaaaacgctggaaaaacgagccgcttcctgaggcttatcctcagtttaagttaaaaggtgtcttaggatctttagggaaaaaagctggctttggcttagtagcagatcgtccacttgttggccgtgtaccaagacttctaaaatccggactcctttggatgtataagcatcacaatggctaacatcatgtgaattttatctcaaagctccttctcgtcgagggagcttttttctatgaaacggcatgtgccgatgaacgggtcaatttgattggagcaagggcaaggatgcagtctttacgaaacgttctcatcgtctttttcgataaacaatacgcttggatgagctggtctgtttgacggtgaacaataattttacgcttcgtgcactctccgttcttcttcatataaatcatctcaattggtatttgctgatgaagagattgtttcagtaaataattcatgatgctcacgctcctttcatttcattataatcgaacaaacgttctttttcaacctaaaaaggaacgtttgttctgtttattttctcaaaaagagaacagtttattcactgctctccgtgtaaccgtatttctccatttcttgataaatgtcttttaatttcggattgccctctccaacaatttgatcctccactaagacaagcggataaaagaattcatcatcaagaattcgttcagacaattccttttggtgttcgttttctggcgggtgctcaatatcaatatatgtgatgcgaaacggctgattcggatattttcgttttaacgctgcatctaaccactcaaatgtgtcttttgaagaaggcagattgacgcagctagcgcagagtacatctcttccatatacataaagatcgacggtttgattcatttaacaagccccctattctttctttattttagctgaattttctgtatgaaaaaagtcaaaatcactttttgtttcaagatgagattgtgctataatgagaaggaaactttgaaaccaatcaatagatttttatcgtccagatgaatataatggtgatatgttgtgaaaggagcgattatatccaatgactgaagtcgaaatgaaagaccaagtacaggaagtactggacaaacttcgtccatttctattacgtgatggtggagactgtgagcttgtagacattgaagatggcattgtgaaattacgtcttcttggtgcatgcggcagctgcccaagttcaaccattacattaaaagccggtattgagcgcgcattattagaagaagtgcctggcgttgtagaagttgaacaggttttctaattcatatatgacatgaaaacgacccgaatttgggtcgttttttttagtttaacttctctctaaaccaatcctttataaaggtcagtctttgaatacgctgccccggatggccgcttctggataaatcatgagatgctttcgggaatttgacgagccttgtgtctttcccaagctccttcagtgctacaaaaagctgttctgcttgatcgactgggcagcgatagtcttcatcgctatgcaggatgagaagcggcgtatttacctgcttcacatactttagcggcgaacgatcccatagcttatcggctgaatcataaatatccccatccatctgccaccttgtgaagtaataaccgatatcactgatgccataaaagctaatccagtttgaaatggaccgctgtgtgacggctgcgcgaaaacggccggtctgtccgacaatccagttggtcataaaaccgccatagctgccgcctgtcactccaagtcttgtttcatcaaggaaatcataggctttcagcacatgatcaacagcttgcatgacatcctcataatcaacgtcaccatagctccctctcacacggtcggtaaacatttgtccgtatccatgactgccatgaggattgatatatacgatggcatagccttcagaagtgagcatttgaaattcatgaaaatacgtataaccatacatggcatgcggtccgccatgaatttctaaaataagcggataagtcttcccctcttccatctgggaaggcttcataaaccagccatgcacctcgccgccttcttttgactgaaacgaaaatggctctggtaccgataggacatgctccttgaggaattcatcatgctcaaacgtgattttctttagatctgcctcccctaatgtcagctcatacagctcacttggtgaaacgggtgacagccggctcagcagcattttggattcattcggatgaaggctgaagtttgtgatatgttctgcctctaatcgaacaggataggctaagccttcaacggagaaataataaatccctgtactgccttgatcagaaacaagcgaataaaatccctggctatcctttgtccactgcggaagctgattggcttcgcccataacgctatcccctgccatacagttgcccacatacatatcgagcatttctgacagctgaatgactttttgctccttcagatcatacagccataatgctgggaaggtcgcattttgaaattcacgctcatgtccaatatacacgaggctctctccattaggagcaaaagacacggtggaataagcgccagcagattgtgtcattttctttgtcgtaccgtcctctaatgatcgaaggcacacgtcacttatgtaaggtttctgaggatttgattgaatataggcaagccatttcccgcacggagagagcgtgtgattcacatgatgatgctctccgctcgtaactgccctggcctctcctgaatgaacatccacttgaatgatctgcgtaaaacgcccatctaaaaagcctctgccatctgctttataggtcaaatcatcatataccgcaggagcgaactcatctcgctcttccttcttttcatcatgaacagtttctgatggtttcagtgacacagccgcataaatgaaagctccatctagtgaaaagacaggatgagataccccgtaaggaatcgccgttaaggtgcgcacaccgcctcccttgctctgaatgagtgcaagctgaggagcttcctttggcttttgcaaaataaacgcaagctgcctgctgtcttttgaccacactggctgatgatgctttccatcctcaaatgtccattgtgacagctcctctgtctcttcatctcgaacccataaatggatattataatcgtctttgttgtcattcaccgtgacctttgtaaaaaccgccttttttccatctggtgaataaaccggatgagaaacagaaacaattttcgttaaatcttctgctgtcatcaatttcttcatgaatgtatctcctccttttatgcataaaaaatagttcgatcctctaaataataatccctgcttcattttataaagaaaagaataaaaaaagaacgtgcattttttacagcacgttctttacttgattgactggatcatgctccacgacaacaccttctactggtaccgtcagcaagtctacttcgcaatgcgggaagttttgggcaagctgctttttcagcgcttctcccttccctttttcaactaaggttaagattgtcggaccagcaccgcttaatgccgttccatacgccccttttagcgaagcgacatgctctaccttcgacagctctgggacgagcattgtgcggtaaggctgatgaaataaatccttattcatcatttctccaacaagcggccagttttgcgtcattaatgccgcaacaagcacgttgctcacagcactcgcactgacggcatgtttataggaaaaatcctctggcaggacatcacgggcatcctttgtcagtacttcataaaaaggaatcacgacgacaacatctatatccacatgctgcactttgacagcatgtgtcttgtcttcttcatggagaccaatcagtaaacctccgaataaagaggcacccgcattatctggatgaccttctacctcacttgcaaaaaagagcttttgatcatccggcatatttaattcaagaagctgattggctagctcaatggctgccacaattgcagcagcactgcttcccagcccccgtgccaatggaatatcactccacactttgacataaacaggcgggagtgtttttccaaagtgatctgcgacctttttagctgtttgataaatgaggttgtcggtgcctgatggaatcccagacacgacttctgattctgcttcaaacagccagctatcatggtcatagaccgatagctttaaataacggctgagcgccattccaactgaatcaaagcctggtcctaaattggcagtgcttcccggtactgtgattgaaaaaagcatggaggctttactcatacgcgcgcggccttttccaagtgttcaagaatttgatcttcatctgcatcgagtgtgaccggcttgatttgtgaaatatcaatggccgtattcggatctttcaatccgttgcctgttaatactgcaacaactttactgcctggcttgatctctccggatttcacctgcttgagcacacctgcgatagacgcacatgagcctggctctgcaaacacgccttcttcacgagcaatcaattgatatgcatggagaatttcttcgtctgtcacttcatcaatctttccgtttgattcatctgccgctgccacagcttgtttccagcttgctggatttccgatacggatagccgttgccactgtttctggctgctcaatcacttcatttctcacgatcgcagctgcgccctctgcttcaaagccgcgcatgacaggcagtccagttccttttttctcatggtattccttgaagcctttccagtaggcggtaatattccccgcatttccaacaggaatcgccagtacgtccggggccgaccctagctgctcacagatttcaaatgccgccgttttctgtccttcaattcgatacggattgacagagttcacaagggcaatcggcgatttttcacagatgctgcggactattttcagtgcatcatcaaagttaccgtcaatcgcaatgatctctgctccgtacatcaccgcctgtgcaagcttgccaaaggcaatttttccgtctggaatgatgacgatacatttcatatcagcacgggctgcataagcggctgccgctgcagaagtattccctgtcgaagcacacatgaccgtatcattgccttcttcttttgcctttgcaacagccatgaccatcccgcggtccttgaaagaacctgttgggttgacgccttctgtttttacatgaagctcaatccctagcttttccgaaagcttggagaggtggatcagcggtgtattcccttcatttaatgttagttttggtgttgattcgtttactggtaagaattcttggaattcttcaataagtccattccacttcatcagcttaaaccgttcccttctactcggtacgtgctcttcacttgaaccaccacgtcgagatcgtttaatttttgcaggatatttgagaaatcttcttctgaggtccggtgtgtaataatcacaatttcagccagctcatcatgccctttcacaggaagctgaaggatcttttcaaagctgatacctctttcagaaaaaatagatgtaatgcgggaaaatgccccgacttgatctctcacatgaattcttaaaaattgctgagcaaatacttccgatggtgatttgatctttttctcaaactgcggtgcaataaatccgcttccgttcacgccaaggcgcatgtttttcatgactgcgactaagtctgataccacagcggttgccgttggcaaacttccagctcctggtccgtaaaacatcgtttctcccacagcacttccatagacatacaccgcattgaattcattgttgaccgatgaaagcggatggtgatcaggaagtaacgttggctggacactgacttctactttttctccgtcccgctgggcaattccgattagcttcattgtgtagccgaatcgtttactgaaattaatgtcttcatcagaaacgtcagagatgccactgacctttacatcctctaattccacattcatggaaaatccaagtcttgcaagaatcgccattttccttgccgcatctagtccttctacatcagctgttggatctgcttctgcaaagcctagatcctgcgcttcttttaagacatcttcatatgcacttttatcgacgttcattttcgttaaaataaaattcgttgtgccgttcacaatccccatcatcttcgtaattcggtcagaggctaatccttcctccagcgtacgcagaatcggaattcctccggcgacacttgcttcataataaagatcacagccattttctttcgccacatgtaaaagctctgttccgtaaagtgccattaaatctttattggcggtaatgacatgcttcttttcatttaaagcatctattaaatattgttttgtctcttcaatgccgcccatcacttcaataatgacgtcgacctctggatctctaatcacatcgtatacttcagttgtgaagacctctcttgccacatccacatctctctttttatcgggattgctcacaagcactttttgtattaataccggacagccgatctggtgcattaatttatcctgatgatcttggataatcttgacgacaccgctccccactgttcctaatcctaatagtccaactcgaattgccttcacctgaaattccacctttctccgtcaatgtcctctctaaaaagacatttgttaacctaacacagacattcaatgtacacacattataaaggggtatcctcgttttgacaaggtaataaaataagagattgttagaatgaaaccgcttaacagctatttatatcaagattctatattttcaaaatatttttgtcagaaaaactcccgaaactcagggagcctaatatgatgagcgaaccggcgttttagcttgctgaccttgtaagacaagcgcaatattttcagcacataaacgcatcatcgtttttctcgtttcaacacttgcacttccaatatgagggagaaccgtgacgttaggtaatgttgttaacggatgagatgggctgacaggttcctgtctaaatacatctaggccagcgccggcaatttttcctgtcgtgactgcctcatataaagcatcctcgtccacagtttgtcctcttgatacgttaataaaataagcagagttcttcatcagatcaaatgccttttcattaaacatatctttcgtttctggggttaacggtgtcaggcagacgatgaaatcagactgcctgagcaaatcctcaaaagccgcgtaggtcacgccgaactgcgcttctgcctctggctttcttgaccggttatgatacagcaccttcatgtcaaagcctgctgcccgcttggcaagcgctgttccgatgctgcccatgccgacaattccaagggttttatgatggatatcagctcctgcaagaagaagcggtccccagcctgtccagtttccgtccttcacccaatcactcgcctcgacaatccgtctagctgacgccattagaagggcaaaggctaaatcagccgtggattctgttaatacatcaggcgtatgacaaatggtgatgttgcgctttttagcggcttcaagatcaatattgtcataacccacagcaaggtttgcgatgaccttaacatgtggagcctttgataaaagggcttcatctacttgatctgacagcatggtgagaagcgcatccgctttcgctgcttgtttttctaattcttctcgtggacatggctcctcttcgctcggccacatctcgatatgagcgacttcttttagtggtgtaagtgatgcttcatccagctttcttgtgatatagacataaggtttcgtcaagaagaacactcctttgattgatttctttaagcataacgaaaaacgcctcaagagaaaagagacgtttcatctgttcactgaaacttcaaatcagtggacctgtgatccagccaacaggtggaatgaggctcccgccgcttcgcatggcactcatttcttgaaagaccttgagaaagtattcatagcgattggcatcatttaagacgtaatctagccgttcttcataatatgatttttcattttctcccgacatgtagtagccttccacaatttcaaaataatgaagcggaaacaacaagcggctgtatagcaaacgcttagaaaaagaagaaagtggtgttacctgctcatattgctgaagaaaggagaagccctcttcaattaaatcttccttatgctggacaaaggtttctcttaaatattcggcaatatcccgggttggatgatcaaagacccaatctacaggtaaacgaagcggctgctcatccggccatgtcctccgcgaaaaacgctggtggcagacagtgcctgagtcacattctttcggttcatcatctagctcagtatccactaaatattgaatggcgttttccgttaatccaagataatacggaaaggattcgataaattttttttcaaaccgttctagtggtttttgatgcatttgctgcatccaaaagccttcaagctgatctaaccgttttgcccataattccttccaggctcccacacgttttgtttcagacacctcatatggaaatcctcttcctctgacatgaaaggccgccagctctgacgcctgttgaaacgagcggcttgagatcggcggtgctgccttcaataaggcatacagctcctttccatgagtaaaggtgggcttctcttcatttgttaattcaaacacagcgacgtatgggtctccggcattcagtaaatactgactgatatgaaacagctctgtgagttcttcttctcgcaaatgagacacaggaacaatgataaagagagcctccgacgtttgaaagctctgataactgccatatggcataagttgacgcacatcaataccaaatgtgtgataaatggtttctttcatgttttcacctgcgttcatatgatcgatctcttatcatatcgtagtcgcaggttgagggatttatgaatactatttactatccgaagctttttacacgttgtggacaaattacgaggattgggtgaggaatatatgccgcatcatcatgagatgaacgaagtagaaaaaacagcaagacgccgtttacaagaacgaggcgtatccattcaagatatagcagaccttgtctactttttacaggaaaaatatcatcctggcttagacatgacagaatgcatccacaatgtggagcgtgtcatcgcaaaacgagaagtccaaaatgcgatattaactggtgtcgaactagacgtactagccgagcaaaaaaaactgaccgagccgcttcagtctattctagaaacagacgaaagcctgtatggcgttgatgaaattttatcatttgctatcgtcaacatttatggttcgatcggctttacgaattacggatatatcgataaagaaaaaccaggaattctcgagacactgaacgataaatccacagggcagtgccatacctttttagatgacattgtcggcgccattgctgctgcagcatcaagcaggctggcacatagtgcgagaaatgtggaatgaagcaaaaaagaggacacgcgcataacgcgcttgtcctctttttttatgataatcgctcaatccactctgataatgaatcaatgacataggttggctgtttatcatatttctgaagcagctcttttgttgtcacgcctgtatgaacgagcaatgtgtccattcctgcattcatccctgccataatatctgtatcatagttatcacccaccatgagcgtctcggacacatcagtcccgagcacccgcatggcttgttccatgatgatcgattctggcttcccgataaatgttggcttgacggtagtggtcacggtcaatacagatgttaacgagccgttccctggcagaagccctctttcagttggaatggcaatgtctccatttgttgagacaaattgtgcgccttgacggatggcaatcgcacctactgcgaatttttcatatgtaatgctgcgatcaattccaacaactacgaaatcagcgtcctcctgaccaaacgtcagccctttttcttcaatggcctgcttgattccttcttcaccgatgacgtacacagacgcgtctttcttttgttcggcaatatagttggctgttgccatacttgttgtaaagacttgttcttctgttgctgggatatcgaatgaaacgagtttttccgctacctgctttggcgtgcgcgacgagttattcgtgacaaacaagtagggaatgttcagctcatttaacttttgaacaaattgacctgcttcttcgatcttttctgttcctttatacattgttccgtctaaatcaattaaatagcctttgtatttcattatgctcacaactccaatggattatttaaacgctgatactgggccaagctcttgctccaagtaggtacggatgcggtttgggaaaacctgtagcgcatgctcaacctcgctgatcacctgcagcaagtcgtgatgaaccacttcttggtattgctgtacaagtgttttgcggcacgagacaagctttttcagctgactgccttcctcttctggtacaaccttttcatcaacaagaatatccatgatgtcatcatagcttcctggatcacgcataataaagccatcaatcatgtcatttcccgtatcaagaatacattcgacaagcacatgaacaattcgttccagcgcttttttctctagtggacttgtccatgtttgatgactctgcatcaactcatattgctcctcgaaaaaacgtaatgtctcttcaatcttttttctgtctacgaaatacatcatgacgctcccctttgcgttattttctgattcgttttaagacaaaataggcacagccaaaattacagtattcataaatgtattcatcgagtgtgctgatttttgtatcaaatgtggccttttggttttggtcatcaaagaaccccttcaatctcagctgattgtagccccagtcccccacaatataatcgtacttatttaaaatatctgagtaccttgctttaaacgcttcttcatcaaaaccgtctttaatatctcttacaagatcaaaagtagcattctgaatgacgatcatcttctcacctctttttaaacgatccatctttaatgataattcattggaagaactccatcaattgctaaagcatgttttttccgatttagccgaagctaaagaaaaaaggaggtcacatttatgaagaaacaactgacagccgcgattctcctcagcatgcttttaggcgggtgcggctttcaatcaggtatgaaccggcaagtggatgaagattcttcaagtaaaaccatccgtctgtcggatcgtcatgaaggaaataattccaacatgccagaagcagacacaaacagagcagggtatgttcgttatcagcgccagcaagtaacggatcagaaagaaagaacacctgctttaaatcgcgagcatcttgcccacgttattacaagtttaactgtgcagctgccaaacatcaaagatgcagcaacacttgtgacagatgagaatgcactcattgtgtatcgtacaggaaacaaaaaccgggatgaatctgccgatcaagtaaagaagacggcggtttctgttctccctcgttattatcatgtatacgtctctgataatccagagcactttcaatccattgccaatttttcacgtcttcaaaccaattcacgtgattttgatcaaatcttaaccaaaacaattcaacaaatgaaatattcccctcaaggtggaaatatttctacgaaagaagatgcaaatggtatgacgaattccgaccgtaccatgagaagaaacgccccttacggacaaaattaacaagagaaaaaacgccagagagatctggcgttttctttgttatgcttgcgcctgacgctttttagacgcttcgtttacttgttcatctgcatggtaggaagagcgcacaagcggtccagcttcacaatgactaaagccttttgacatcgcaatttctttcagctctgcaaactcatccggatgataatatttttgaacttttagatgttttttcgaaggctgtaaatactgaccaatcgccataatatcgacgttgttagcaagaagatcatccatgacttcaatgatttcttccttcgtttcaccgagtccaatcataatgcttgatttcgttggaatgtcgggctgcatttcttttgcacggcgcaagaattctaatgaacgatcatatgtagcacgcgcacgaacccttggcgttaatctgcgaactgtttcaatattgtgatttaaaatatcaggacgtgtgtccattaacgtcttcaaattatcgtaattgccgcccatatctgaagggagaacttcaattgtcgtaaatgggctttttcttctaatggcacgaacggtttcagcaaacacacctgctccgccatccttttggtcatcccttgcaaccgctgttatcacagcatgttttaagttcattaacgctactgaatctgccacgcgttctggttcttgcaggtcaagctcagttggaagtccagttttcaccgcacagaaacggcatgcgcgcgtacaaacagatccaaggatcataaatgtagcggttcttctcactgcccagcattcatgaatattcggacattttgcttcctcacaaacggtattcaggttgttttcccgcatcatttttttcaaaccggtatagttttcattcgtattcagcttaattttaagccagtccggttttcttacgtgctcttccttctttgccaattccatcatctccatatgaattcgttaaaggtgcatctacaaaaatcttcctgctatatacgatggatgcagctaagaagctgcaaaaaattgaatcttcggcctaaagccttttctttagacactttaacatagtacagattgaacaacaagggaatgagctgcaaaaatacccaaaagcctcctaaaaaaatcacaagaaaattactaacattttcttcttatgaaatagggtgatctaaccacactaaacggtagaagacgatgcttgatgaaaggagatggacgtttgtgaaagtggttttagccatcatgatcgctctttcaatgctccctttacctgttcatgcacaaggggaaggcaagcagccagatgtactgaagcagcgaatggcactatacgaaaaagtcgccatcacgacacaagttccatggtatgtacttgctgcggttgatcagtatgagcacaatattcgaaaaagcagaagagatttaccgaaacaaaaaggcatcattggtatctacattccccgggaaatgtggatcggccctgaaaacccgaataagcaggatacctctcctttaagcattaaagtgtttgatggaattggacttgatggaaacggggatggaaaagcgaacagcgatgacgatgaggacgtattattcacgtttgctcaatacttgcttcattacggcaacagcattgatcaactaaaaattgctttatgggactattatggacgagatcaaaccgttggaatcatttcatcttttatgaagctatatcagcactatggtcatcttgacctcggaaagcacgctttccctcttccggttggggctgactacagctaccggagcacatggggagatgcaagaggatttggaggcagaagaattcatgagggtacggatttatttgcccattatggacttcccgttcgtgcgacatcgtatggtgtgattgaaatgaagggctggaaccgctttggcggctggcggattggtattcgagatattcataaccattatcattacttcgctcatttgaatggctttgcaaaaggactcaaaacaggtcaaattgttgaacccggacaggtcattggatctgtcggaagctccggttatggccctccaggcacagcaggaaaatttccgcctcatcttcactatggcatgtataaagacaacggcagaactgaatggtcttttgatccctaccctcatttaagggcatgggaaagggctgaacggaaacgcaaatagaaaacagcccaatcattccttgggctgttattctttcttctcctttttctcaggaagaacaatcgatggagcgccagagttcgttccgctgccattgtaataatctggtacgtccccttgaacggcttggatggagacgggaactgagtttttgaccacgattgtttcagatgcaaacgggatgatgactcttaccttgacctcgatcagaacactaatatcaatcaaggcattgttgatgccataaggcttaatgtttttttcaacgtccgtatgcggatcaccaatgacactgaagcgtacaggtactttgggtcctaggttggcgatgagtgcatttccggacgcttgaccaagcggaatgttatatataatgccgtcatgtccatctgtttgatcctttaatgcttcttttgcctctttttgaaaattccccttttcaatgtcctctaaatttttttgaagatgacgtgacagaccagccattgctttcgatgttgcttgcgcattaaaatcgatggtcgttacttttccgttctcacttgtattcatgaccaccatatccttcatattctcctgatcttctgcaaagtcttggacggaatattgaatcagatgattggcgatacgctctgtttctagttcagcaatgtgaataagggttggtttaatggaacggttaataaaaaatagactgatgacagttgagagtacaaagaataagatcgcaagcagcatgacgtatcggaatggcaaagggccctttttataggggcgatagcggcggttcattctcaataaaaaatccccccttctccattacaagtgtatgcagacaggcggggggataggaatcatctctccattttatttcatcatttttaataaggcgtctcttccaatggttccaactgtaatgcctaacgcttctgcagtgtatgtcacagattctaatggggcatcaagcaattgctctatcgttctcactccaactgctctccctgcgataatgcctctatctgcaagcttttcatttaagagcccgacatccagtgcaccgcacataatatacccatgttcatttgtcactgccataaaattcgtcttcggcagtttgacggtgacggctgtaaaggaatgtccatcaatattaataggtgttaaattcaccaaatcccttcactcctctcatcacaatctatgtgacaagagggcgagtgttgttaggcaaaagcggatttcatgtggcttccttcaggcgccaagtaagcacatcacgtaaaaattccggcatgaaatattcaatgtgttcatggtcacgaatatgaggaaatagagagcctaatgtatacatatcgactgttccaaccgtataggaagcgtctttattgatcaattgatcatgcacaaaaacatccttcacccgtttggtttcgccttcttctaatgtataggtgagaccgctatacagcattttgcccatcagttcacctctaaagccgaagcccttgatgcgcagctgttccattttttcttcacatgcacgccgaacggtttcgatgagctgttgacccgaaagcgtcacacgaatagggttaatgggatgcgggcagattcgatggacttcttctctagtcacaattcctgcctctaatgaatcaagcaccatcccagcattcatcatgccgatatctgccccgcaccaatctttaatggcatctgttaagagctgcggaagcggggattcatcaaaccacttcgtttctaaccttgactcaatcgcggttactttttcctgcatgagggctttcgctcttctctctgcttgctgtaaagtagtgatggcttcatctgattcactgatcagctgatccactgactgcaccgttgcttttttctcgatgagctctttgctcgctgtatcaatggtcagctcgacacagccaatataatgcccatacttttcagcgcatgcaagcagcactccattgtccatttcaccctgttctaacaaatgatgcgtgtgtgaacctaggataatatcgatgtcaggaaaatcacgggcgacttcccgatcatggatgatacctagatgggataagagcacaatgacatccgcttttcccttcacttcctgcagcatgtcccgtatgctgtcaaacggatctgtaatctcccagcccagcttttcatagacaggtgtatacgcaatggtcacgcctaagagacatattttcagtccattttccatttggattatatgataaggctttgcccacgatggccttttgcctttctcaaataaattagacaggatcactggaaattgtgcatgctcatacaattgatcgagctgatcatgaggcagtgtaatgccttcattattcccaatcgtgaccccatcatagccaagttgattgagaagcttgacatttacttttccataatcagcttctgacacaaggttcactcggtccatatggtcgccaatatcaaacaagagcatctgatcgtgaacttgacgcttttcctcaatataagctgcgatttttggccagttctcaaagtggctgtgcaagtcgtttgtatgatataaccatagcttctgcagcatgttgatctctccctcaagttgtcactgaaccatctcattcaggttgaaagccgcagctctcatttaactaaataaatttaactgcttcggagaaaggcttgaatacgtaatatccagcaaatcaatcatctgctggccattcgccgctgcatctccgccggagttattattaaatacgacatagacatcttttgattgctgatgcagaatgtcgagattctttttccactcttctaattcagcttcattatataaatataagtatcgcacttcacgccaattttcatgatccgctgggtgaagccagccctgtttatttctcccgtgaaaacgaaccaatgttttatcacggtgcgtagcttgtatgactggcggaatggagccttctcccacttgcggctcatcacaaacagaatgaatccagccttctttttccataaaggacaaggtctgctcataaaattcatctgagaaccatgtgcggttacggaattcgagggcacatggaatgtcgcccatcttctctttacaccatcttaaataaaggacgtgctcttttttgcaatcaaaccatggtggaaattgaaatagaaccatggctaatttccctgcacgaatgagcggagtcaatgaaagaataaatgcgtcaaacatctcttccttcgaagcaaacggaatttcgcccctctgatgaccggtcattccttgatatgcttttacgacaaattgaaaggtatctggcgtatccttgatccacttttcatgattacgttcaggctgaactgcataaaagctggcatccagctccacaatgggaaacgtagacgaatagtgaaacagcttttgcgcgctgccgattttcggcggataaagactgtcatggtctccccagccagttaatccgatataaatcatgtttctcacctcttgccactttcatgtatagacggcttcctcacatgaaagcctttttctcttgtcatacccatctttctgaaagaaattcttctgtctacaacatatcatatttgccggtaattctgaatgaagatgactgatggtgcgtgattttatcatgatttctgtttgtttgtcatgttagttgacaatattctatctaaaatgatgtgagctgataacatactatatatcagagaagtgaacagtgattgtccatttatttattcatcttcaccaagaactttagttctcaataaaggagacttagtggatatgaacatagacgataaccaatttgaaacattgcaaaaaatcgccaaaaagattcacaaacctgtctatttgtgtaaccagcatgggcgtcttctcggcaactcgcccatcacgcgaccagattggattcgcattctcccctttttccaaagcagggcaccccattatttttcgataatcgatacgaagcaaaccttttctgtctttccgattgatctagccgaacaaacatgtgagtatgtggtcatcccttccttcattcttccgctggatgaaacactgcaagtcatcattgaacaagccgtacacgaaatctcgattgcgcgaatgagacaatatactgtccagcaaacagccaagcgtgccagaaatgaagggtttcgcagatggatagaggggttatcgtcttctcagcaagacgctgcatacgttgcgaaggcgtttggattaaatgtagatagcagctatctatgcatgatctatcagcttgatcagtgtcatgagaccactcattttttgaagcagcaactaatattagatcaagtcgttgatctgctcgacagcgcactgccaagctctcctttcccttcctttttatttgtcaaaggtgatatgggcattctattaatggaagagacgggcagttggtctgagatgagtgacagactcctctcttttttaaaacagctgcagatgctcgttagcatacaagtgaatcacaccatttccttcggtgtgagcttgactagttgtcgcatcacccatctgtttgagggctacagtgaggcattagacgcacttcaagccggacatctctcggcacagccggaatatatacacttctatcaagcaaaggatgtgccagatttattgaagcttattccaagaaaggatttaatcacgtttcaccaaatgcaccttcatccgttatatgaagctggtcaaaacctcctccacaccatatctgtctatttagaaacacattgccacatttcagaaacagcaaaacgtttgtcaattcatcgcaacacggtcatttatcgattggaaaagtgtgaagagctgcttcgaatcagcttaaaagaccctgaagccacattaaggctgcgcttagcattacgtattcagatgcttctttcaccccatcctgattgaatgttttcttccgaagcttcatatagtttggaggagaaaagtgatacaagaggagggatgatcaatggatggtgagctgggtcacatcccgcagccaattcgagaggatggtgctggtgccaccgatctaggcccgcgggacgtccttcgagacatcgagaaccccgatatgcttgttccacctaaaaccgatgccggaaccattccaaacttgaaattttcatattccgatacacatatgcatttgaatcctggcggctggtcaagagaaattacgaagcgagagctgcctgtttccacaacgattgcgggtgtcaacatgcggctgactcgaggcggagtgcgagaactccattggcataagcaggctgaatgggcgtatatgattttaggaaaagcccgtatcacctctgtagatgcagaagggcgaaatatgatcgctgatgtagcagaaggagatttatggtatttcccgccaggtattccgcactccattcaaggacttgaggacgggtgtgaatttcttttagtctttgatgatggcactttttctgaatttgatacgttcaccatcacagactggtttgcccatacaccgaaaaacattctctccgaaaattttggcgttcctgagaagctgtttgatgatattccgaataagcagcgctacatgtttcaaggctctccaccagcatcattagaaagccaaacggtatctgatccatacggaagcatcgagccaccatttacgtaccagctgcttcgccaaaaaccgctgacgacctctggaggaactgtccgcattgtcgattcacggaatttccctgtttcaaaaaccattgcagctgcgcttgttgaagtaaagcctggcggcatgagagaaatgcactggcatcctaataatgctgagtggcaatactatttaacaggtacagccaaaatgacggtctttggagccggtggcactgcccgcacctttaattacagagcaggtgatgtcggatatgttccttttggtatgggacattacatccaaaatatcggtcaaacgagcctttggtttttagaaatgtttaaaagtgaccgctttgcagatatttcgttgaatcagtggatggccttaacccctcctcaattagtgaaagagcatttgcatgtaggtgatgccatgattcgtgcgcttcataaagaaaaatcacctgtcgtgacatataaaaggtgatgaccataaaaaaaccgatccatttgtgctgatcggttttttataattgaattttaagaaattgcagaacgctgctgcacttttttcccccacacgatggatgcaatgaagcttatgcaaagcaccagggttccgagcataaaagggaactcaatattcacatcaaataaaatgcccgcaaggctcggtccaacaatattggcaaggctcataaaggatgtattgaggccgcccgctactccttgctgattacctgccattttggacagcaatgtattgagggctggacgaacaaatgatgtagccgacaaaaataaaatagagcctgcaaagatcagccaaaatgacggcgcaacacggcagacgatgagcatcaaagccgctcccagcagggcataacgcacgacgcgcatttcaccaaatcgtttcacagaggcattcaccaacgcaccttggacaagcacgccagcaagacccgcaactgtaatcacaaacgcaatatccttcggtgtaaatccatgtttttgatctacatataagccgaaaatcgattcaaagtgaatgatgccaaaattgaggacaaacgccaatataaacaaaaaaccgtaggatgtctttaaagcttgcatcatttgtacaaatgggttgaaatgaatgtctttgtttaaccgcgcttcttcctgcttttcctttgttaatgtttcaggtaaaaacaggatggacaatagggtagaaagagctgcaaaggaacctgcgatgagaaaaggaaaagcgattccgtactcgaccaaatagccgcctacgcctggtccaatgacaaagcctaacgtcattgctgcactaaatagccccattcctttccctcgatccttctcacttgtgatatcagcgatatatgcaaacatggctggcatgagtaaagctccggcagcaccacctaaaaaccgagacacaaacagcatccaaagctgatcagcaaatgcaaaaataaactgggcaatcgtaaagccggcgatcccggcaatgatcaattttctacgtccaaatcgatcggtcagtgcgcctgcgaccggcgataaagcaaactgtgtgagacctgttgcagcgacaagaaaaccgagtgtttttcctgttgcgccaaaggtctcaatgtaacttggcatgacagggacaatgaggccaaagccaagcatggcaataaaaatattgagcatcaaaatatataatctgcccatttttttcatatcaaaaaacctctttctgctaaataaatgaaaatgatgacaaaaatgatcagaacttcttcagtatagcgatatcactgtctataagtctagtttttcaaaatttagttttcttttccaaataaaaaatacccgcaaatagcgagtatccttatgactttattcaccttgttcatagatagaaagagccgcctgaagccctgcaccgcaatggatagatgcaccatgcttgattagaattgcttctagccctgctaacacaaagagcacattttcttttcggcagctatagcccattgtaccaattctccatatacgtccggctagcggtccaaaggagctggcaatttcaataccaaaatgcttaagcagatcggcacgtaccgcttctccatccataccacttggaatctcaatacatgtcacaactggcattttacaatgtggatcaccgaacaattgaagtcccatcgcttcaagacctttcatcaaggctttctcgtgatatgcgtgcctttgaaaacgctcagacagaccttcttccagcacaacacgaaccccttcacgaagtgcatagagcatcgttgtcgcttctgtatgatgatttaatcgcctagggctccaataatcctggagctggctgagatcaaagtaattgcttttaattggcgaaatatccatttgctcctgcaattcatcctgtgtcgcaatacccttttccactttctttctcgactcaacgacagctgccacccgttcattatacgtgataggggacatacctgatggaactgacaagcacttctgcgtaccgccaatcgccgcatcaatcttccattcgtccactttcacctggaccccgccaatggttgctacagcgtctacaatgaacaacgcatccagtgctcggcacgcttcaccgatttgctctagcggctgcaatcgcccggtggatgtttcaccatggaccatcgcaacgattttaggcttaacctgcttcattttctgaatgatatcactaggatcaaaaaccgttccccattcacattccattgtatgtacatcagccccatagcgctgtccaatttcaatgagaagatgaccgaaccggccaaagacaggcacaagcatcgaatctcccggctcaatgacactggcaagcacagcttcaagccctgaacgagacgtgccgtcaattggaaaagcccattcattttctgtttgaaaaagggaacgcaataaagtcatcgtctcattcatgatatgtgtaaatgctggatcaaattgaccgagaattggcgtactcatcacacggagtaccctgggatctacttcaacaggtcctggtgtcataatcgttcttgaaggtatttgtagttctttcacgttatccatcctttcccttgctgtcatcctatatgcccacttataccgtaatgctgataaaatagcaatctcttttcctgcgaatttattacataaaatttacgataaatccatttatttctttctgacattatgatagaaataaagagaatacattccctatcaaggaggaaatcgaatgaagagaaccttatttggaattgtggctgccggaatcatgatattcggtacgttagccgccccgctgccgcaagctgcgaatgctcaaagctttactctgaatgaaccgagccaaaccatcacattttccccgttacagcttcaaaacgaaacatctgcacagcaaacgaaaacaacagctacaagtcaaatcgattcctattatcaaactgctaatggcaaatcaggacccactttaaagaaagctttacacgatattattgatgatcataagcagctatcctacagccaagtttgggatgccttaaagaaaacagatgaagatccaaaaagtccaaacaacgtgctcttgctctatagcggtgtctcccgttcaaagcaagcgaatggcggtaatgttggtcagtggaaccgggagcatgtgtgggctaagtcacacggcaattttgggacaagccagggcccaggtacagatctccatcacctgcgggcaacagacgtacaaacgaatagcactcgtggaaatttagattttgatatgggcggaaatgaatacaagggagcaccgggcaatttctatgatagcgactcattcgaacctcatagccgggtgaaaggggatgtggcaagaatgctcttttatatggcagtgcgatacgaaggggatgaccgctttccagatttagaattaaacgaaaaagtgaataatggcagcgcccctctccatggcaaaatgtccgtactcctcaagtggcacaaacaagatcctgtcgatcaaatcgaacgaaaccgcaacgagatcatttatcaaacataccagaacaaccgcaatccctttatcgatcacccagaatgggcaagtgcgatttgggaataaaaaagaaaggcactgctacgaacaagcagtgcctttctttttatcaagtggacagacaagacaataatcgagactctccgattttttctcgagcttataatacatacagcaagtctttcgattggatgtttctagtaaactatcatctaagtttaagctgtgatgaaatggattttgttttgctccgaatacattccccgctgcttgcttcagatacagatagtcctcccgtacgcgctgcttcacagcagggtcttcagcctcccgcatcatgcttcgataaagagaattgatacgaactgctacattctcccataaaatagaatatggaagtcttgacgtgcgctttaatacatctaaaagaggtgtaacacactccgtaaacagcgcatgcacaacctgctctctccattcattccgatctccttctaatgaaacaaacgaacacaatgactcatcaatctcgattttccgatcctctctaaagacacatgcctctggtggaaactgatagacaccgtcatacagcgtcatcatgtacaaagaggaactgaccgctaagtaggcataacgctttgaaaacatcgacgacgctacagctaaattcggtgcatgcatcgcttctttttcagcctctaataaacgcaggacagatgcttctgaaaaaagcgcggcaagtgtgcgatcagatgtcattggtccatttgtgatgtgtacgccgaaatcaagtaattctctctcaacccactctggcctcatatcaaaacctccatctttcgtttatcgatttctctgctggtataacaaataaataaagaacggtgccccaattgcagctgtgaatacacctgctggtacatctaacggtagaaaagccgttctagcgactaaatctgcgagcatcacgagaatactgccaacaagtgcagatgccgggacaagcgcaatgaaggaacgaccgatgatcatccgtgcgacatgcggcgccatcagtccaacaaattcaataccgcctgcaaaggcaaccgcaatccccgccaatgtcacactcatcagtagaaagaataacctttttgcctgcacttttaccccgagacctgttgcaagatcatctccaagctccttcacattcatcgttcttgctaacaccatgacaatcggtaaaatgaccatgatccaaggaaacatcgccgtgacgtccttcatcgtagaaccatataaactgcctgtcagccaaatatatgattttgtcgtcgtcatcgtatcactaagaacaagagtaaacgtcacacacgccttcatgatggcagaaatcccgatgcccattagaacaagtgtgatcggcttgactccttttttccatgaaagcaaataaatcagacacgagacggcaaacgccccggcaatcgcccacaaggattgatacgcaataggcacagtgcccatccaaaaaacaataaacataatcgcaccgaacgaagcaccactcgtaatcccaatgatgtcaggtgatgcaagtggattgcggattaacccttgcaaaataagccctgataccgcaagtgcggctcccactaagacagccagcaatgttcttgggatcctcagtgtattaagcacaaaggtatttccctctccctgaccgattaaatgaagaagcacatccacaggcgaaataaatcggctgcccatacagagactgagaataaataacccaaaagcaatggccgtcaataaaagtaaaattaaaaacgtccgctttgaaaattgaaatgaaatgcgtccgccctttgaacgcactgtatatgttttagccacctgtcttcaaccccttgcgcacgagataaacaaacagaggcgctcctgctaccgccgtcatgacaccaatcggtacttcctgcggcatgatcagaaaacgagccgcaaggtctgcgacaagtaatagagacgcccccactacggcacaataaggcagtacccagcggtggtcaggtccgacaagctttttcacaatatgcggcactagaaaaccaacaaagccaattgaaccagcaacagcgacggaaccacccgctaaaaagacgacgagaacccccatcgtgattttcagcatcagcgtacgctggccaagtcccttcgcaatatcatctcctgacaaaaggacgttgatggaacgtccaagaagcagcgccacaactgtcgcacctaaaatataaggcaaaacaggcagcagcatatcaatgtttcttccagacactgaacccgccatccagaacaggatgctttgaatcgactgttcattcacgattaaaagtccttgtgtaaaggacgcaaacagtgcagatattgccgctcccgcaaggacaattttgaccggtgtcaatccatctcttccaatggaacccaaaagaaaaacaagcatccctgcaattgccgcacctagaaaggctgtccacatatagcctgttaatgactctgttgaaaagaaaacaatcgaaatgacgataaaaaatagtccacctgcattaattcctaacaaatctggtgctgcaagcgggtttctcgttaatgcctgcatcagtgcacctgaaatggctagacttgatccaacaacagttgcaattaaagctcttgataatctggatgtcatgacaatgacactgtttggatccgattcatcaaattgaagaaacgcatggatggtggctttgagggaaatggaggtttgccctagagaaatgctgagcataaaaaagaccaacatcaatacgacgaatccaacaaacagcagcgccttgctcgaatccttttttaataaacttctcatctgattcccgctttcaatctgttatggaaaaaggagaaaatggtttttcacattttctcctctgttatccttatttatcaatgccgagacgatcataaatatcatcaagcatcatgtttgcagcaataataccgccgcccatgttccaagtgatttcatcgactttatgcacttgtttcgctttcactgcgtcaagctgcttccataaaggatgactcgtccactctttatatgctttttcaaccgctttatcctgatcatccatgaagtaatagatcacatctgcatccatttgcggaatgctctctttgtctgtaagtgtaatgatgtcttgctttttatctttgacattcttaggtccttcaaagcctagctctgttaaaatggaccctgcgaaaccagtttgatagattctagcatgatctgcacggaagttcactacagacacactcattggccagtttttgatgtcttttttcgctttttctttgaagtcagcgacgcggtcatcccacttcgtcagcaattcttttgatttgtcttgctgatttaacgcttcacccattaatttcactgtatctttaaatgtgaacactgtttcagttgcaacagttggagcgatttctttcagctgatcaaaaatttgctcgtggcggacttttgatgcaatgatcaaatctgggttaagcttttcaatttcctctaggtttggctgtatttcctgcccaacaattttgacatcctttaagtcatctcttaaatatttatacgtaggtgcttcaagccaagattctacaacacccactggtttaatgcccattgcgactgctgcatcggttgctccttggtacagcgtcaccacacgtttaggcgatcctttaatttcagttgaaccgatagcgctttcaacggttcttgctttttctttactatttgacttgccttcactgctattgctgccgcaagctgcaagtaaaacgatggagagcacaactaatagcgaccaaaaagattttttgaacatgtacctcacctatccattctatatgtagtcatatcgtttgataacgattctcattatcacactatgattttatcatagaaaaggatggtgtcaatgtaaatttttaagaaaaagggagagtgttgactagttgttcatactaaatagaacgattccacatttggatagtcttaccgatttgttctcccgcttctagtaacaccgacaaatgggtatgtccatccagcacttcatagactgattgttgcttgatctcttcatttggcagttcatgataggcagaaaatttttctatatcatatagctcatcctcgctgcctactatcatcgcatagggccgatcaatcctagcaaattgttttttaggtgcagaaggggttaaagcaagtgatagattgacggtgatggctgttaatagaagcggatcctgctcaactacccatgctggataatgaaaacgcacggcttcagaatgacccatcagcatcccttttgtcatagcagacaaaacgaatttccatacttgaacggtcgcaaaaggaatttgatcaggtcttgcagtgtctgattgatagccaaattcaggtgcaataaaaaagtaaccgtctacttctctttttttcggccaagataggtaatttagcagtaatcccgctccagaagaatgcccgcaaagataaacagctcctttatgctgctgtttgaccgtatccacaaactgcgaaatatcttgccacacatctgtgacactaggtgtatcacccttttttccttccgaatggccgtgacctcttaaatcaattaaaaacgtattcacatgaaaatcatgtttcagcgtataggcgatatgctcgtaaccagctaggctgtgagcgcctccgccatggatcaagatgacatttgcctcgttctgcttttctgctaaaaatgaataatacgcaaggcttgtgccgtcgtgtgatggcatgaattgtctttctggaatatgaacaggggctacctgctgcatacttgcaaatgagaatggttcgttcttggtgtctgtcaatgattcgctccttcaaacagaaacgagaatggccagctgcgctagtcatcctcattcctatatcttagtcattgcattctttcaaagggaaggtattactttcaataatctcgacaatttggtttaacgctttttttgcttctggtatagggaaaacaggaaacacatgattcattttaggatattctatatagtttattggaaccccctgcttctctgctatctctttgaatttacgggcatctgggaggaagaattcgtgagtgcctataaaaacagaaattcgtcccaatgctttgatctctccataaattggactgactaagtggtgtgtttcatccatgtcacccgcatatctttttcctgcttcaattaataaggctagattgagcattggttcttttggaaccatcgcagcgatatctgggttgcttaatgtaacatctagccatggtgataaaagaatgatattcccaggctgcggcaagctcttttttgccaagtattgagcaaaagctaacgataaacctccgccagcagaatcacccatgatgacgatattttcaggtattcctttctctaaaagagcttggtacacaggaaggacactctcgatcgcatccatatactgatggtttggtgcttttggataaaccggcacatacaccgtactatttaattgcttcgtcaatcggtctaaaaaacgccaatgccaagtcaaaggctgttcaatatagccgccaccgtgtataaacaacacttgatggtcatccggctggacatttgatttcaacatatacgtatcgactagaaacgagtgatttttagtgattttgtacttattcttaattttttcaggcaattcataaggtaattcatttgcccttcttcgttcttctagataatcatttacattgagtttctttttcgtcaaaacaagcagctgttctactaaaaagctttgaatacttcgcatatgatcgccccctgttcatagaatcatgatgttcgatgtctctggaaagaaaaggcttctaaagcataccataagaatacgcacatcaggtaaaccacttttgaaaaaacctttttatcctgatgatcactcatcatcacaaacagatattcattaatgaacaactgtttatttattgttactcatattctactttttagacgcatgacaatcaattgtcaatctgatcctaaccgttcattaatagacagatgacgactgaatgttcatttcgtcaatgtccagacatgaaaaaagacgaacggtcatcgttcgtcttcttccctcacttcacttcttcattctcctgaaccgcatgtcgtttactagcgataaaaagtgcaacagtcatagctaaaatagtcagcgcccaccagaaggtcgatacagcctctttatgatcgatgataatcaaacggataacggctgtgatgccaatataaataaaatagcgaagcggaaaatgaaagtttgatttaaagtacttaataattaaggcaatgaactcaaagtacataaagaagatcagcagctcaccaagcatttcataacagctttctcctttgttgaccacattcttgtagacaaattggacaatataccatgtttcactaattaagagaacgcttaaagcaagggctagaaagaatagacagatattcagcagaccttgcaagagatcgggtaccttttggaaattgttgaatcgtttcatgagattgtctctccattccatattattcatttgtcatctatattttgatgtgccagaatcgcagcacggtgtagtaaacgccgttcttttccatcttttcaaactgcccgtgcatgcgggacatcattcgtttaatgcttcgttcaccaagcccagtgctttcctgcgtgtcatttgtctcttttatcgcattgctgacatggatctcaaagatttcttgatcggatagaaacgtgagattgatgtcttttttcggatcggcgtatttcagtatgttcgacatcagattatcaaacactctgcccagctcctcgacattcacgttgatatagctgtctggcagctctcctaaaagatgaaccttgaatgtctcttgctgcaagatcgccacctgatctgataggagatcgtaaatgacctctttgactgcaacggtctcaagctcaggttcatgttctttatcaagcagaaaataggcaaacagattatcggaaagatttttcaattgcagtgctttgtcataagcacttgctatatattgatctttacgtgtatccgccccagccgcctcttttttcgcaaactctaaattcatcattagcgatgtcagcggtgttctcatatcgtgcgacatttcagtaactaagctgcggctctcttcttgcagctcatcgatggcttgaagcttgtccagaaaagctttacgaagatcctcaatacttttagcaatcatcgctaattcatcatgccctttcaccgtcatctcgtaatccagctcgccgccttcaagaatatgaatgtcttggtgaatcgtttgcaggtagcgtaaacttttgcgaatgccaagcagaacaatgaggaggaaaataagcgtcgctccgagcagctcaagtgtaaaggcaagatcgtggtaacgagatgaatagaaaccatccaccatgacccgaccttcaccgtcactaaactgaaccggatacgaatgatgctcagcatactgggtcaccttttcttttccgtaagccgattcatcagcagccgaatagatggagtcatattgcagcacttcatccttgaagatggtcaaattaatgtaattctcttttttcacccactcaccaaacgcttgtcgatttgtagaagacagctcattctcagacacatagcggctgaatttttgaatatatctagctgactccgcctcgtaatactcgtctgaactcaaatatccgtcaatgaggtcattggtgattttttgcagcgtcaaaaagacaagtccactcacaaccgtagctgtcaaaatcagcagtgccagctttttggctagtgtatatttacgatgtgccaaatcggtatcctcttccccattcggttttgatatataaaggacgtgccggatcatcttcaattttggcacgcagctttcgaatatgcaccatcaccgtattgttggaacaatagaaataaggctgtccccacacgctctcataaatattttgggctgaaaagattttgtttcgcctgctcatgagcagcttgagcacacgatattctaaatcagacagcttgatttgttgattttctttccacacttcattaaattcttcgctcaccctcagcttgcccccaacaagaaaagtttcttcctgttccttcttttcctgatagacggtgtacctgcgtaattgtgcaatcactctagcatgaagctcctcttgtgaaaaaggttttgtcatataatcatccccgccggcaagtaagccttcggttttatcgaatgtacctgatttggctgttagaaacagaatcgggacattagaagaggctctcatctgctggcacgtttcaatgcctgatatgcctggcatcatcacatccaaaatcaccaaatcgagcgaatcgtccacaaacttcaatgcttgctcgccattcatcgctctttgcacctcatatccagcacgtgtaagggattcctgtaaaaggtctccaatatcctgatcatcttctacgactaatattcgatgtgtcatgtttctctcacctcatgatacgtgatgtactttctattatgcctttactatatatcatctagctatgtgaaaagatacagcataaatcttaacagtttatgaatttgaccaccttccatcaatttgtcacatttattttcaaataattggatcttcataaattgttaagaattgggacgtatattgattcattgtaaggatcgttgaactgatccgaatgacatttatcataacaagaaaaggagcatggatatgaatgcaaacaaagtagcacacgcgatgagtttgaaagatcggatccatttcttagacatcgtacggggatttgccctaatgggaattattctggtgaattactttttgattgtggattcggcgaaggggttcgatatgggagcaaatgatgtctttcataacttggtgaattggttcgcctcagggaaattcattacgttgttctccttcctattcggggttggttttatgatttttatggatcgagcggctcagagggtgaacaatccgaacaagctgtttgcccgcagattaaccattcttttaggatttggccttctgcatttaacctttgtttggattggtgatattttagcgtattatgcagtcgctggctttttattgctcttcttttacaaacgcacagccaaaaccatcggatactggttgatcgcactctttgtgattcaattgctcacgccctttttcacgatgctgctcaataccatcaattcaggatcatcaggcaagccggacttggctgattttgaattaatcagccacaacagcctgacttatttagcatctatcggtgatcggtggacagatatggtcacgatggcttccagttctttttctactgtctattccatgttcttcatgtttttactaggtgtgtattttgtgaaaatggcgtttttcaaaaacatggaggcgaaaaaagcgatttggaatcgcatttggatcatttgtacaatcgcttttctcatcactcaaagcagtacgatcattgtagcaatcaatccttttgaaaatacaccctgggtgagcattgccactactctggaacaaaacggaggattaactggcagtatgttttatatgagtacacttgcgatgctgtttctgcacgttcctcagctgcgaggtgctttaatggtctttacaaaagtcggacggatgtccctgacctgttatttgcttcactcgatcattggaacgatgctatttctaaagtatggagcggggcttgtcgatcatctccagccggctggtacgttctttatggctattggcgtgtatgtcttccttgtgcttttcagtacgttttggttaaagcactttaagtatggaccgatggaatttatttggcgtcagctgacgtatgggaaggtcaatgacagatccaaaaccaatatatttcatgcggcgaagtaaaagaaaaaaggcgaatggctacagttcgccttttttaatatgtgaagtttttgtgattcagagacaattcgttcactttcaatactgatccatcatttcttgcaattgagtcaaataactcttttttaattcatctgggtattcaattttcacatgtttcccaaatgagatcaaatagtgagtcatatacgataattcttcttgattgtacccacccataatataaggagtatcatcaatgatctccaatctcatattcggataatgattcttcagaaacttttctttcccttgttccgttaatcgacatttaaatgagatatcatgataagttttttcgtactcgacctgcattgcttttaattcttccttcgtaaaggtgtcactgccttcttcttcaatgatcaagtccttcataaaatcacatctatagatgccccactttttattttgaacatcatatgctttggtgaaccaaatcccatttcgataaaataactcaagaaattgcagcctgatccttttattttcatattgagtgtacgtcatcttcacgatttgatcttccatcatcgcctgtaaaatcaattccaaatgattttgttcactaactggtgcgacattatagtaatgaatcacttccaaagtctccgtaatcatttgttttctctcatcagacattgtggcaaacagcttttgccgaatttgtgagtaggactttttaaatggtgtggctgacaccagatctagcgctttaagcgcgaaaaaaatagcttgaacttcaacgatattgaaataaatagggaccattggagattgtttcaccagtcgatatcctccatgtctgccattttcaacataaaaagctaaacccatggactctagttcttccatatctctcaacgccgtacgtttcgatatgccaaattcggtttctaaatcctttaattgaaaagagtacttatcacttaaaaaaataagttcctgatttaatcgttctgattttttcatttgattttccttttgaaaaaggtgacatgttttgtcacctttatattttatactcagtttatcaaaagaaaaggagcatgtatatgcaaacattaattattaacgcgcaccctgatttcactcatcgagaaagttattcacacaaactgcaaacactatttttagaacattttaaagaaagattccctcatgaagaaccaacaattttacatttacatgaaactgaaattcctcgtatcgaaaaagaccagctgctacgtatttggaataagcaagcatctgaacaaacattaacagcggccgaagagaaaatcgttgctgcttcatctgctttattggctcaattcaaagcacatcatcgaatcgtgattgtatcacctgttcataatttcaatgtgacgtcacgtatgaaagattatatagataatattttgattgctagagaaacgtttaaatacacagaaaatggttcagttggtctgatgacagacgattatcgtgtacttttgcttcaagcaagcggctcaattttcacaaataacgatcgatacacacctctggaattttcacattactacctaaaagaaatattccaaaacttaatgggctttcaacaatttcatattgtccgagcacaaggaacagcgattttagaagaggaaacgatcttgacagctgcagctgacgatttgtctaaagcctttgatgcgttttactcacctagcgggatgtaagatctgttttttcaaaaacaaaaagaccaaaaacgtttgatatcacgtttttggtcttttttattattaaccgattgaaccttccatctcgaacttaatcaaacggttcatttcaacggcgtattccattggtagttcttttgtgaatggctcgatgaagcccatgacgatcatttctgttgcttcttcttcagaaattccgcggctcatcaagtagaatagctgctcttctgatacttttgataccttcgcttcgtgctctaatgaaatgttgtcgtttaggatttcattgtaaggaatcgtatcagatgttgatttgttatccatgatgagtgtgtcacactcgatgtttgagcgtgcaccctctgctttacgtccgaaatgaacgattccacggtatgtgactttaccgccttgtttcgaaattgatttcgatacgatcgttgaagaagtgtttggtgcaaggtgaatcattttcgcacctgcatcttggtgctgacctttacctgctagggcaatacttaatgtcatcccacgagcgccttcaccttttaggatgaccgctgggtatttcattgtcagcttagaaccgatgtttccatcaatccattccatcgttgcattttcttcacatactgtacgtttcgtcacaaggttgaagacgttgtttgcccagttttgaatcgttgtataacgacagtagccgccttttttcacgatgatttcaacaaccgcactgtgaagtgagtttgttgtgtaaactggagctgtacagccttctacgtaatgcacatgtgcgccttcatcaacaataatcagtgtacgctcgaactgacccatgttttcagagttgatacggaagtatgcttgaagtggagtatctacttttatcccttttggtacgtagataaatgaaccaccagaccatacagccgagttaagcgcagcaaatttgttgtcagtcggaggaatgacctttgcccagtgctcacggaagatgtcttcgttttcttttaatgcgctgtctgtatctttaaacacaatgcctagatcttcaaggtcttgcttcatgttgtgatacacaacttcagattcatactgagcagatacacctgctaagtacttttgctctgcttctgggatcccaagcttatcaaaggtttgtttgatttcttctggtacttcatcccaagaacgctcagagcgctctgatggctttacgtagtacgtaatttcatcaaagtttaatgcatttaaatctccgccccattgtggcatcggcatgttgtaaaagtgctcaagagatttcaatcggaagtcgagcatccattgaggctcttctttcatacgagaaatttcttcaacgatctcttttgtcagtccgcgctctgaacggaaaatggaaacgtctttatcagaaaagccgtatttatattcaccaacatctggcatttttttagccatccattttcactccaatcttatgatttgccgttatcttcggcagatgcgcctttttcaagcgccttccatgataatgttgcacatttgatgcgggcagggaattttgctactccctgcagcgcctcaatgtcaccaagatcaatggaatcgtcgtattcttttcctagcatcatatcggagaaaatctgagacattttcaaagctgtttcaatatctttccctttaatcgcctgcgtcatcatagaggcagatgccattgaaatcgagcatccttctccttcaaatttcgcatcggtgactttttcgttttcgattttcatcgtgagacgaatgcggtcaccacacgttgggttgttcatatcgacgacaatgctgtcgtttaacacacctttgtttctcggatttttataatgatccataatcacttgtctgtacagtgtgtctaagtttacattaaaagacattcgtaaaatactcctttgtcttacggagcgctgcaataagttggtcaatctcttcttctgtattatacagataaaagcttgctcttgcagtcgctgatacaccaagccatttcatgagcggctgtgcacagtggtgtccagcacgaatggcgacaccttccgtatctagaacagtagacgcatcatgcggatggacgtcatctaagttaaacgtcacaagcccggctcggtgctgcggtccataaacagtcgcaccgtcaagctctttgaagcgctcaagtgcataagtggcaagctgatgctcgtaacggctgacttcctgcataccaatgtcatttaagaaatcaatggcttttccgagtccaattgctccggcaataatcggtgttcccgcttcaaatttccacggaagctctttccaagtagaatcatacagatccacaaagtcgatcatttcaccgccaaactcagcaggctccatattattcaaaaggtccttcttcccgtaaagtacaccaatgccagtcggtccacacattttatgtccagagaatgcgaaaaagtcacaatctagatcctgaacatcaatttgcatatgcggtgtgctctgcgcaccatcgacaacgataatagcaccgtgatcgtgggcaatctttgcgatttctttaatcgggttgatggttcctaatacgtttgagacatgtgtgacagcaacgattttcgtttgatgtgtgatcgtttgtttcacatcttcaagcgatagtgtgccgtcttcctgtaacggaatgtatttcaatgtggcgccagttgcttttgctgcttgctgccaagggatgatattcgcatggtgctccatgagcgtaatgacaatctcatcgccttctttgaggtttgctctagcatagctgatcgccactgtgtttagtgcagttgttgtacctctagtaaaaataatctcctggacagatgaagcacggatgaatgcacgaactttctctctcgcaccctcgtatgcgtccgttgctcttgtaccaagggtatgaacaccccggtggacgttcgagttgtaagaccggtaatactcattcattgcatcaatgaccactcttggtttttgagaagtcgctgcactgtccaaatacaccaaatcatgtccgttcacttgctgatgaaggattggaaattgctcacgaacgtctttgatattcattattttactttcctttcaatcacagaaacgagctgctttttaactccttcaatcggcagttctttgacaactggatttaagaagccataaatcacaagtctttctgcatcttctttggaaatcccgcggctcatgaggtaatacagttgaattggatcgacacgtccaacagaagcagcatgccctgctgttacatcatcttcatcaattaatagaattgggtttgcatcaccgcgtgctttctcactcagcatgagaacacgtgattcctgctcggcatttgacttcgttgcgccatgctcgattttaccaattccgttaaagatagaggatgcttgatccttcatcacaccatgcttcaagatatacccttcagagtttttaccgaagtgaatgatgcttgttgtaaagttttccgtttgattcccgcggccgacaacaactgattttgtatcaccaaatgtaccgtcgcccataagctttgtgatgttttcagacacgacgtctccatcattcatcaagccaagcgcccattcgattttactgtcacggccacttgccataccgcgtctattcacatagactgtgacaccttcagaaaggttatctactgcaccgtaagtgacgcgagcattagcacccgtgaacacttcggacacgatattgaagattgcttcttcaggttttgctgtactgatgtagttttctacatatgtcactgcactatgatcgtctgctacgacgatgacatggttgaacaaagtcgtgtcgtcattttcatgcaggtagacggcttgaattggcgcttcaagttctacatttttcggtacatagaggaaagctccgccattcactaaagcagcatgtaaagctgttagtttatgctcatctactttcactgcatccgtcatgaagtatttcttcactagatcaccatgttcgcgaagcgctgtatgaagatcagtgaagatcacgcctttgtctttcgcttctgttgaaagagacaagtaggctggcgtttgatcacgctgaatgtagactgtcttatccgtgtcctctaaatcaatgagagatttcacttcttcaggaagctcttctaatgatccaaatggcgcgctttcgactgtatgctgtttgaaattggttaaattccatttagaaatattcgttttgtcaggctttggcattggaaggtcttctgctttttcaagagcctgtaagcgaagggaactcatccatgccggttcctgatgcttctcggagaagcttttgacataatcttgatctactgataatttcgtttctaatgtcatcaataatcctcctaacgcttacgcttcttgaccaacagtttcgtcttcaattcctaactcttttttaatccagtcatagccttctgcttctagacgctgcgcgagttctggtccgccagatttcacgatacgtccttgcatcatgacatgaacatgatctggtgtgatgtagttcagtagacgctgatagtgagtgatcattaagcagccgaagctttcgccgcgcattctgttaattcctttagaaaccactttcaacgcatcgatatcaagaccagaatcgatttcgtcaagaatggcaattttaggttcaatcatcattaattgaagaatttcgttgcgttttttctccccgcctgagaaaccttcgtttaggtagcgctgcgccatgtctgggtccatttcaaggaactccatgttttcgtccattttgcggataaatttcatgagagagatttcatcgccttcttctctgcgagcgttaatagcagaacgaaggaagtccgcatttgtcacaccactaatttcagatgggtattgcattgcaaggaaaagacctgcttgagcgcgctcatctacttccatttcaagtacatcttcgccatcaagcaaaatgctgccttttgttacttcatatttagggtgacccataattgcagcagataaagttgatttacctgtaccgtttggtcccattactgcgtggaattctccaccttttatctcgaggtttacaccctttaagatttctttcccttcaatctcaacgtgcaagtccttaattgttaatgtcgaagcagtcatatatcgatacctccaaaataatcattattctcaatttattctcattctaattttataacaaattaaaagtgaatacaacacattcacgataagcgtgagaggatgctctcaaaattctaacaaaaaaagccggtagataaaaggatttatgtcgaaaagactgttttcataaagaaaggacgggaaactgttctcccgtccctaagctatttaatagcctcgtatattcatttttgcgagctgtcttttctcatctcgataggactgctctcgtttatattccactttcatccgtaagtcatggtctctttcgtactctgcatagctcatgccatgagccttatgcatggccttttccatctcggcggtataatccaatcccagtgtactatggtccgaacaaataataaaccattcccttctttgagtgtagctttattgtatcaaagacatgcggcttcactcaaaagggatatagcgcgctatgctggcatattttctcacacaaaaggctgagaacgactcaactccctgagatggataaataccatcttatccttcccttaatgcgtctgtcctccaaattcgtcaatacattgctgaacgacagtaatcccttggctcagtgctgccccgccgccaaatgctgccgccacgctgacaacctccagcaaattctcctctgtcgcgccttgatcgagtgccccctttgtatgataaatcatgcagtattcatcctgtgcatgaatactgatgccaagagcaatcatttgtttttccttttgcgttaatgaatcgctctgaaagcactgctccgtgaattcattgaatttcttcccaaacaccggcattttcttctgaaattcacccattgcggttttataatcagtcagtgattgctgcatggatccgctcatatgctgttcattcatcttcattccatcccttcaggtcatttgtacatttttattatgagcgagatttgaaaaaatacacaaaaaaacctcgctttgacgaaagcgaggttacagattgttgacaaaggtctaaaatgaacttaattttagacctttgtcttcctttcagcgtgatagaaaacctttgcagtgtaggaaggacgagtactggagcggagcgaatccgacattcgtgagcaccagcacgcaggactgacaccgaatgcgagggtttgtctacacgctgaaacctcgcttcgatgaaagcgaggttaacacatggttattcagataccggtagtacagcaccgtcatattttttgtcgatgaattctttgattttatcagagtgaagaacttccattaaagtcttgatcttatctgatttttcctcacctttgcgaaccgccacgatgtttgcgtatgggttgttctttgtttgctcaagttcgattgaatcgtttttcggattcaatttattttggatcgcatagttgacgttgataaacacagcatcgccttcactgttttcataagctttcgctgttagttcaggagcgatttttttgaactttaggttctttggattttctttgatgttctttacagtagcgttgattgtatcgacctttggatcaagtttgatgacaccagcattttgtaatagggcaagcatacgtccttgctcagctacgttatttgtcatgatgatcgtgccgccgtttggaatatcttttactgatttgtatttcttagagtagataccgaatggctcaaggtgaaccgcaccagcactcacaaggttgtaatctttgtttgatttattttcttcgtttaagtaagggatatgttggaaaaagttcgcatccacttctttttcagataacgctttgttgtacattttgtaatcgctaagtaccttcactttgaggtcgtagcctttttcttttagaagtggttttgcttcttcaagaatctcggcatgtggtgtttttgaagcagcaaccgtaatggttttgctatcacttgcgttattagatgaaccgcatgcagctaaaatgcctgcaaatgctaggaatagtgcacttaaaatcaatttcttcatgaataaatcctcccttatcgtttatcaattttatttgtaatcaaatcaccgattatttgaataataaagacgatgatgagaataaacacagtggcaacaagtgtgacatctgtattaccagattggtatccttccacataggcaaggtcaccaagtccgcctgctccaattgcacctgcaatcgcagttgagccaattaaagcaatcgctgttacggtaatacctgaaatgagggctggcaatgattctggcagcaatactttgaaaatgatggtcgatgttttcgctcccattgagcgtgctgcttcaatgactcctttgtctacctcacgcagtgcaatttcgacaagacgtgcatagaatggagctgacccaatgacaagggcagggagtgctgcatttggacctagaattgtatgcattaagaatttcgtgaaccctaataaaagaataattaaaatgataaaaggaatcgatctgaaaatgttgacgactgcaccgatgactgtgttgatcggtttattttcccaaagaccacctttacttgtgagaaagagcaggagtccaagaataattccgatcacaaaggcaaatgccaatgaaatgagtgtcatatagaccgtttcacccgttgcattccaaatgacttctaaatcaacgttcggaaaccatttctcaaacatgtgtcatcacctcaatttcaacctgtttactttggatataggcgatggctttttctacctcggtctcttctccattaatatggataaagagtgttccaaacgcgccttcctgcgtttgagaaatctttccttgaaggatgtttacatcgacattgaaggatcgaatgatttcagtgatgagcggctgctcggcagaatcaccaataaaggacaaccgtacgacctgaccttcttttacacgctctaagacgtgctcgattgtttctttcgcttcctctggttcagcaagctgctggacaaatcgcttcgtcatttcttccttcggctgtctgaagacgcgtaatacttcgccttcttcgactatgcgtccattctccatcactgccacgcgatgacaaattttgcgaatgacatgcatttcgtgtgtaatcagcacaatcgtcagcccaagtcgtttattgatatctgctaaaagatcaaggatagaatccgttgtttgcggatcaagcgctgatgttgcttcgtcacaaagaagaacctttggatcatttgctaatgctctcgcaatccccacacgctgtttttgtccgccactaagctgagacggatacgcattttcttttccttctaaaccgactaatttaatcagttcattcgcacgttctcttcgttttgatgcctttacacctgcgatctcaagcgggaacataatattttgtctcaccgttcttgaccaaagtaggttaaagtgctggaaaatcatgctgatttcttgtcttgctatccgaagtttcgcattcgatacttcattgatccggttgcctgccacttcaacaattcctgttgttggcagctccagaccgtttaataggcgaataagcgagcttttcccggcaccgctatacccgataattccgaatatttcacctttaccaatatccaagttgacgtctttcacggcatcaacatttccgctttttgaatgatacgtttttgatacattctgtaaatggatcacagtctgttcacctgctttcttgctgaatctataggttgccatcacatacattatttattcttcctgctgccatgcttcgcgcctggcttgaggtcagtaaaaaagacctaactgcaatgcaagcagaaaggccttttatgttcaatacgcctttctctcatctttcaaagcattgcggctttgagtgaattggcaccaatttcagctatgctgacggttgccgggtttcatagggcacgtccctccacctctcttaataagagaaaatatgttgttttatgtgatgttcatgtttttactaacgtagaatatcatgctacccgagatatgtcaacgctgtaaatcgctaatttcctagtaaacgactacgttatcatttttcgaaaaaaaccgttcgtcagccaaagcaccgcctctagtcttaggagcgcacggaatgacccttttactttcacttgtcccctgctaattaactgctgtaaggacatatctccatctaataattgaagtatttcttttctctcaccataaaagatgagatccgataactcaattgcaggtagtttcttcacttcaccacgctcatccacaatcaatgtacaagagtcagtttccgcctcaaatgtaatcttcaaggatgatgatgagagcagcggctttagcaataatcgctgccctgttgtgttaccatgggttttcactttttccacatgtataacctccctgtcatttggttatacataacatttctctacaaacattggcttgtcctttataaataactcgacaaattttcagatgaattgcttgaaatatgacaaaaaaccgctttatttagcggtttcaatcatttcgtgaagatatggaacagagtgaaaggcatagcctttttgcactagctcaccttttttaaacagtagaaagcaaggaacgctttcgatctcaaaagctttcgcaaagcctggtgagtagtttaagttattttcgtaaaatggtacatccggctgcatggtgtcaacgacagcaagcattttctttgccagctgacatgtcccgcaaaacggtgtatataagtataaaagaaataaatcgtcctttatctccttgaattcgtgttcttcaatctctttcatatacgtccaccctcatacatatttcgaatgaacatcaatgtttgcagctaataggatagatgcaatgtgggctgacggtgaagcggccacttcgcggtacgttctgtcgacaaaaagatgaagtgcttcagggaattcttttcgaaattgcttccgcagtttgtcgcctgcatcgtcactgtctgctaatatgtaaacgtctttccccaataattcgtctacgagctgatccagcttcgatgtactgatcgtgccattggtgcaaatgatggtaacaggttcacttatgacttcttttagcttttgtttgtctgttttaccttctacaatgatgaccttttctacctctacattcatcacgatcacccggcccttttgacgttgttcacttctcccttagattacaatctttcatcgaggttgtaaagattggggcttgcactaaaaagactgcagcttatgctcactgcagccttatctgtgattagcaccagccattttcatcatcacagtctacatatttttctgtcccgtgggtcaatgtatccgtcagacgataaaaacgattttgatcataggaataacctgattttaactcatattggttttcactaatcatcgtgccaatctcttcattttgatgatacagcaccatgccgctttctttgaatcgtccagtgacatgatctgttatatccacctgttctttttgaaaagacaaattggacaccccccataaaggtagagtgtccaatttcacgtgaattagtcttcttttgtcatttcttcatattgctcagcagtcatcaagttctcaatttcagatgtatcagctggctctaccacgatcatccatgctttttcgtatggagagtcattgacgaattcagggctgtcatccagctcatcgttcacttcaacgattgtgccgttgatcggtgcgtaaagctcagaaactgttttcactgattctacacttccgaaaggctcgtccgctgtaattttgtctcctacttcaggaagctcaacgaacacgatatcgcctagctcagattgagcaaaatgcgtaataccgatacgcaccttatctccttctactttgacccattcatgttcttctgaataacgtaaatcttttggtgtgctcattcaatacccctccagtcttttctttcaatctatattgaagataccacaatctgaatgaaagttacatcatttccagacgcttttaaatgtatcttcattaaatccaactgtgactcgtttaccgtctgttgtaatcggacgcttgatcagcattccgttagatgcgagtaattctagctgctcgtcctctgacattgcaggaagttgatctttcagctgcagctctcggtatttctgtccgcttgtattaaagaatttcttcagctctaagccgcttttttcataaagggcttttaatgtttctttatcaggcgtctcttcgacgatatgtatgctgttgatgtctttattgtgttcttccagccatttttttgcttttcggcatgtactgcaagatgggtattcataaaaatctaaagccaccattttcacctcctgcaaatagtgacaacattttatcacaaaatattttaaaaacctaaatgtatgcttacaaaaaggtgcggaatgatatccgcaccttttaagccgtcttatacgatatatttctctgcttcaaagattcgtttcgccacttcgcgctttttggcgatgacattaatcggggtgaatcttgtcagtttgcgaagagctgacagactcatgcggagtgcatctccttcttccatcgcgatcaaggattcttttgcatgggcttcaatttttaagaaggcttcctgcgtgaaaatttgtgtgtaagcaagcttttgagcattcttatcaagccctgatgcagcgattgccttttcagtacgcagaatcgccgattcagcagcaaaaatttcattgacgatatccgctatgttcacaagaatctcttgctctttgtctaatgcttttccatacttcatcgccgccattccagataccattaaggcgatctttttcgcatgggtgagcaagtatttttcttgatcgagcggctgatcacccggctcttccggcatcatcatcatgagctcttcctgtaaggtttgcgccttttgaagaagcggaagctctcccttcatcgctttcttcaagaatgtgcctggtacaagcagacggttgatttcgtttgtcccttcaaaaatacggttaatccgcgagtcacgataggctctttcgacctcgtattcttgcatgaatccatatccgccgtgaatctgcacgccctcatccgcaatatagtctaaagtttcagagccaagcactttacaaagagagcattcaattgcatattctgcaatggactgggcaatttgtttgccgtccttttgctcttcttcacttaatagacccatgcgctgttcaaataatccaactgtgcggtaaacagcactttccatcgcatagagctttgccgacatgttggctactttttcaccaattaagctaaatcgagaaattggcgtttggaattgcttacgctggtttgcgtattctgctgataattgaatgacacgttttgacgcgccaactgtcccgacagccagcttgtagcgtccgatatttaaaatattaaaggcaatgacatgacctctgccagcctcacctaataaattctcttttggcacttgagcatcttcaaggattaacgttctcgtcgaggaccctttaatgcccatctttttctcttcaggtcccgttttgacaccaggaaaatccttttctacgataaaagcagagaagtgttcaccatcaattttcgcatatacgacaaagacgtcggcaaatgcggagtttgtgatccattgtttttccccattcaacacataatgagttccggcttcatttaagaccgcagttgtctttgctccaagagcgtcagagcctgatcctggctcagttagggcgtacgccgcaattgtttctccagaagcaagtcctggcaggtatgtttccttttgcgcttgatttccgaacagtacgatgggcagagatccaatgccgacatgggcgccataggaaagtgagaagctccctgctctggagaatttctcggtaataatggctgaactgattttatctaatccgagcccgccgaattcttcaggcacgtcagctcctagcagcccaagctctccagcctttttgagaagcctgacagaatgctcaaattcatgcttttcaatttgatctatatatggaacaacgtcttgtaaaatataatcctctgttgtctttccaatcatttgatgctcatcagtgaaatcctctggtgcaaagatatgctcataattcgtctcatcaattaagaagcttccacccttttttacctcttccattgctttcatcctgatttccccctttagatcaattcaaaaattcctgctgctcccatgcccccgccgatacacattgtgacgataccaaattgctcgtttcgacgtttcatttcatgaataagtgacagtgtcagtttcgttcctgtacagccgagcggatgtccgagcgcaattgccccgccattcacattcactttctcttcatcaatccctaaatgacgaatgacttgaatggcctgagaggcaaacgcttcgtttaattcaaacagcccgatatctttcagctcaagtccagctattttcagcgcacgcggaatggcttcaattggaccgattcccatcacctcaggcggtacaccgccaacagcaaacgcccggaacttggcgagtggctgaagggaaagtgaggatgctttctcacgatccatcatcatcacacacgcagcgccgtcacttgtttgtgaagagtttcctgcggttaccgtcccctttgttgaaaaagccggacgcaaagtcgaaagaatctcctccgttgtccctgctcttacgccttcatcctgtgagaacgtgaattgatgttcttctaattgatattgctctcctacccgccgctctgttacatcaacggagacaatttcatctgaaaactttccttcctgtaatgctttggctgccttttgatgacttcttaccgcaaaggcgtcctgatcttgacgtgtgacctgatacttttgcgccacctgctctgccgtgtgtcccatgctcatgtagtattcaggcgcttgttctgccaaatgagcattcggacgaatggagtgacccatcatcggcacctgtgacatcgattcgacgccaccagctaagattgtttctgcctgaccgagcatgattcgttcacccgcataagcgatggactgaagaccagatgagcagtagcggttaatggtgatggcagggactgtatacggaagccctgctaatgctccaatattccgagccacatttaacccctgctctgcttctggtgttgcacatccgataatcaaatcatctatctgtccgtcgtaatcaccggcacgctttaatgtttcttttacacacaatgcgcccatatcatcaggtcgaacatgttttaacgatccttttttcgccttccctactggtgttctcgcgccagcgacaatgactgcttctctcattttgactcccccttagttacgtaaaggttttcctttgacgagcatgtgctgcatgcgtgcttgtgatttcacttctcctacaagacttaaaaaggcttccctttcaagctctaataagtattgctcctctacttctgttccaaatggcagttttccgccggaaataacatgagctaattttttaacaatggtcatgtcatgctctgaaatgtatccagacaatctcatattttcagccgccaatatcattgctgcatagcctgtttcgcccatgacgggcaccttttgcttgagcggcgcacgataacccgcttcatcaagagagagcacaagttgtttcgcatcatagatcaagtgatctccgttcatactgattcggtcactcgcgcgaagcatgttcatatcccgcgcttcctctgccgaagtggatactttcgccattgcaattgtttcaaatgttttcatcgtggcgtcttgtatagcggtctgcgatggcttcgctgatccttgtagatggcgaaggtataattctttgtttccaccgccgcctggaatcagtccaactcccgcttcgacaagacccatgtatgcttcactcgacgcctgaatagctgctgccggcagacaaacctctgttccgcctccgagtgtcataccaaacggtgcagcaacgattggacggtcgctatatttcaccttcatcattgcctgctggaagcggcggatcacaaagtcaatttcaaagaaattatcgtcctgagcttccattaaaatcaaagcaaggttggcaccaacacagaagttcttgccttggtttccgatgacaagccctctataattttgttccacctcatcgacagcgcgattgatcatgtcaatgacatctagtccaatggcattgcttttggagtgaaattcgagcaaggcgacatcatcaccgatatcgatcaagctcgcaccagcatttttaaaaataacgccgtgcttctttttcaatctcgctaaggaaatattcttttcgtttcctttttcctgttcataagtcccattatgataaaacgcacgctctccatcagcattctcttgatagaatgtatcgtgtccttctgaaagcatgtcttgcacccactgcgggatgctgtgaccttctgcttccatgcgctcgactgcttttttcacaccgattgcatcccatagctcaaatggaccgtgctgccagccaaacccccatttcattgcgttatcgatggactgaatgtcatccgcaatttcgcctgttaactgagccgaataaaggagcacaggtgccgtcatgttccagagcaattgtcctgcacgcccatcttgataaataagcgctttcaatctcgctttcgttcccttttgctgcttcgccatctcaatgcctggatctttcagcttcgttcgttctccatatgtgagcgtcacaggatcaagttctaaaatggcctttccattcttttgataaaacccttgccctgccttgctgccaatccatcccttttcaagcattctttcaataaactcaggaagctggaaaatatctttttctttaccttctacttggtcatatacgttgcgggctacatggaaaaacgtgtcgagtcctacgacatcaagtgtacggaaggtcgcacttttcggtcttccaatgaggggtcctgtgactgaatccacctctccaatggtgtatttgttttcaagcatttcacgcactgtcacaaggagtccataagtaccaatacgattggcaataaagttcggcgtatctttcgcttccacgacgcctttaccaagtacatcctcgccaaacgttttcataaattggagtacttctggatctgtttcttgaataggaatgatttctaaaagctttaaataacgagcggggttaaaaaaatgagtgcctaaaaagtggcgtttaaaatcctctgatcggccttctgccattttttcaaccgaaattcccgatgtgttacttgatacgatgctgccttctttgcggtgttcgtcgatgagcgagaatacgtgctttttgatgctgagcttttcagtgacgacttcaatgatccagtcagcatcttgtaataaggaaaggtgatctgtgagatttcccggtgtgatgtatgataggttttttgctgaagtaagaggtgctggcttttgctttaacaattttttcatcgcttcttgacttaatctattccgaacactagggtgatcaagcgttcgcttttttgccgtttcttcctttgtcagttcgtttggcacaatatctagcaatgttactggtatcccgatattgcctagatgcgcagcaatgcctgagcccatgacacctgaaccaatgacagccgccttgcgaatatgtttgcccataaatatccccctaaacattttgaatgaacagtcattcatttttttgtccaaaaaaaagcaatgcctctttctttatcttaaaagattttccgaaacagttcaagtacggatttcaaaaatttacacattctcatgtgccttactttgcggcgtatgaattaaagacgagagggcattgtaagaatggaggtgatgtccacatgtctcgtttgaagaaaaacccatcgaaagcaggcgtaagtgctgcaagtgtaaaaggaaacgcagatccatcacaggaagcagacctaggcggcaaaaagactagtcaaaatcagcaatataaaaagaatcagtaaggaaacaaaatcgtaaggaggaacacaccttgaacaatcagcaaatgaatatgcccccgcaagtcatttcagtgaaggattccttgtacttagaggatatgctgaattggaacttgatcgctatgaaaaaggctcactttatggccgagcattgccaggaccaaacattgaaacaagaattaaatcaagtgggccaaatgcaccatcagcattacacacaaattcttcagcatttaggcagctcagggcaaggccagtctactggctttatgcaataggaggaaaaaacatggaacagcaaaaccaacaaaaaatcgggaatcctcaaaccccggttcccacaacaacaaacatgaatgatcgtgattttgtcacagatctcttgtcgactgaaaaatatatgacaagcggatacaacacagcgctcaatgaattcagtcatgaatctctttatcaggatattcagcgaatcgcgctagaaactcagaaaacacaaagacatttatatgatgtcatgttccgatatgggtggtattcagttgaagccgctgagcagcaaaagcttcagcaggcacaccagaaatttcagcaaacactgacagaacaatctccatacggaccatcacagatgtcataaagaaaaactgccagtatggagctggcagtttttttaacggtcttgattggatcgatgagcttcgttcatttgtttgatccgctgaatggtttctttgatttcttccttagcctctggatacgtttcattaaagtgctttgctagaggcggcatactttttgcaatatgagaatagatgacccactgtttcacatcttgtttcagctcgtctgttgattcaccgagcagcagctctgtatatttctcaagcaagccttccagcttttcgtctagttcatttcccattttgatcttccgctccttttttcagaaaaaagcctgactctgtacgtaacagatgtcaggcttttgacatacgattatcttgcagcgagaaatgtctccgcttgcgcttgctgcacaatacagcgtcctctgccatgcggaatacataatggcgttccgaataaaggatctgttgtcacttggcagttcatatcaaagacatttttcacaagatcacaattaatgaccgtttctggtcttccttctgcataaatcgtcttgtctttaatcgctacaaggtgatgagcatatctacaagcgagattcaggtcatgaagaaccatgacgatcgtgcgctgctctttttcatttaagtcaaacagaaggtcgagaatttcaatttgatgcgtcatgtctaaatatgtcgtcggctcatctaacaaaatgatatccgtttcctgcgctaacgtcatcgcaatccatgcacgctgcctttgtccacctgataatgaatcgaccgttcgatcagcaaggtcttccatcttcgttgacttcagtgcacgattcactgcttcctcgtcctgctttgaccactgcttcagccaattttgataaggatatctgccttgcttcactaattgatgcacagttaatccttctggcgcttctggtccttgcggaagaatggcgagctgtttcgctacttcctttgttggtaatttggcaatggaatgaccttcaagcaggacagaaccacccattggcttcatgagacgggccaaagagcgaagtagcgtggatttaccgcatccattgctgccaataaatactgtgatttcacccttagggattgatacatttagttcatctatgatcattgtttctccgtagcctaagcttaaaccttcagtagaaatggcactcattccgctcaaacgctccttttctcatgcaaattttttatatgaaatatcgtctatatatagacgcaaaagatcacttatctcaatttagtgtatcagatttaagtgatcttgaaaatcattttcaattaaaaaatgagaaagttccgttttacttcttcttttggaatgtacgtttggtcccatcttcaagcttaatatcgacctgaattcgctgataatcatcgtctaaattaaaagcagctaatagctcatttacatacgtttcattgatcttcgcactaggaatagacatatcatttagcttcatcttcatctcccgtaatgcttcttcaccttcatagcggacaccgttcatatgatcacgaataagtgcttcttctttgcctttcgcctgacgataggtggcttcgtataattcgcttttctgcccgtattgaacatgcaggtggagatactcaaatggaagttccttcatttgaaccgctgaaagactctctgcttctgcttcctttgtttgctggagcggctcgattgattggcagccagacagcataaaaagcagcactcctatttgtcccgccttcttccaacacatcatgtgcttcctcctatttcttatcatcgctttttattcttctccatccttcttttcgttattcaataaaagagcgggctatggtaaattgaaacaaaaaggaggtacgagatgatgaaaaggacagccattgtaactggtgccaatagcggctttggcaagctcatcacgataggtctcgccaagcaaggctatacagtgattgcaggcgtcaggcaggaagccaatgcgaaaaagcttgctgaagaaatcgagcaagtctcgttatccgaagcgatacatattgaagcattagatgtgacagacacgcagtcgattcaagcatttcagaaaaaactacatgcttacgcccctattaccctgcttgtcaacaatgcaggaacagcctatgcgggttttgctgaagaagttcctgttgacacgtaccgccagcaatttgatgtcaatgttttcggagtcatggaagtgacacaagccgtccttccgtttatgacaaatggtgcaaagatattcaatatgagcagcatcagcggattaatgggaatgcccgcactttctccttatgtatcttccaagtttgctttagagggctacacagagagcttgcgcattgaactagcctcgttcggtatacaggcagccttgatcgagccaggctctttccaaacgaatatttggaacacgtctatgaacgagcacatgttgcagccagaggaaggctcgaaatacatacacatttatcaaaagatgatggctcatatcaatgcccagaaatcaaactacggggacccgcgtgaagtcgcagaccttgtgattcgattagctgagaagaagcggctgaaaaagctgagatatccgattgggaaaggagtgcgactttcatttaccgcaaagcagcttctgccttggagcatgtgggaaaagatcatattacgtacactctcttcaaaaaaataagcataaaaaaacaggtagacctttaacgtccacctgttttttcatttattcagtttcagactgtccaagggtaatgtctagatttttgtttttcccttcacgaatgacagtcattgttgttttatcgccgacttttgtttctttgtacaaaatttctttcagctgagagctgttcgccacgtttttccctttaaacttgatgatgacatctccagacttcaagcctgctttttgtgcaggtgatccttttgatacatcctttacgtaaatccctttaccgatttgtttatcaaataggccgagcgtattttcttgatatgtttcaggcacttgctcaagatcaatcatttgtacgccaaggtaaggacgttcaacctttccgtttttcaacagctcatctactatcggtttgacatcgttacttggaatcgcaaagccgagtgattccacaccgctttcgctaatttttaagctgttgataccgatgacttgaccatctgtattgataagcggtccaccgctgtttcctggattgatcgctgcatctgtttgcagtacattcatttccaccgtaccagatgacgtgttcgcttcaactgtacgatcaagaccactaataatcccttctgttacagtaccagagaactgggcaccaagcgggtttccaattgcgatcactttgtctccagcacgaagcttagaagaatcaccaaagcttgccactttatcaatgccgtctgcattgatttctacaaccgctaaatctgtcatcacgtcactgccgacgagcttcgcgtcttttgtttttccgtcataaagtgtgaccttcaatttattggcaccctcgactacgtggttatttgtaataatgtacgcttttttcccatcctttttaaagatgacaccagaacccgttccagcttcagcttctgttgaatcaccgctaaggccaaacgaattttgggtagattgatagtttgagactcccacaatggttggctctaaatcttctaccatatcagaaacatttgtggcattggtgatttgttttgttgagaaattttcagaggccgctggttcacttgacgctgtttgcgtttgattgtttgctgctgtgtcctgtgactgcggcaaaagcggtgtaatgccaagcacaaggccgccgccaataattccgccaaggatcggactgagccatgctgctttccgctttttctcctttttcgacgcacggtcatcccccatttgaggagaatggtttgtcacactctcctgagtggcagaagcttcgttttcatgaggttgaaaaacgacttccttttctttttcaggttcgtctatttgtttctcattctcttgatgtacatcttcttcttgattcaaattcttctcttcatcttctcttcgaaaatccatcgcttacactcctttacatcatgttcatgacttgcttgattcatatgtgtagataggactcatgtcctcttaatggcaacatcattgaagatactacatgacaataagtcaaattatataatacttattcatagaaaaaaagcaaggtgcgcacattcgtgaaaagcacctattgatctgccttttgtctatgcccttttttcccttgagcttatcataaacaaacattatgggataataatgagaagaatatgtgaaattgtgaaaaatgcatgagattgttgacatgccgcctttatatcccgttataatgacgttgagaggatgtggaagactttgtcgtacaccatttatttagtggaagatgaacaaaacttaaacgaacttttaaccaaatatttagaaagtgaaaattggaatgtctcctcttttttaaccggagaagcggcacgcgaagcaatgaataagccgccgcatctatggattttagatatcatgctgcctgatacagatggctacacactgattaaagaaatcaaagccgcatcacctgacgtaccggtcattttcatttcagcacgcgacgctgatattgatcgtgtcctcggtttagagctgggaagcagtgattatattgcgaaaccatttcttccgcgcgagctgatcattcgggtgcaaaagctgcttgagcttgtgtataaaaacagcgatactccgcagcagcaaagtgttacacccgtttcctcttatgtcattcatgaggatgtaagagaggtgtatgaagaagatcagctgattaacttaacttctaaggaatttgacttgctgcttttatttacacatcatcaaggacatgctttttctcgtgaagatattctcgtcaaaatttggggacacgattactttgggacagatcgtgtggtggatgaccttgtcagacgattgcgcaaaaaaatgcccgacttaaaggtcgagaccatctatggatttggctataggatgctaaaaggatgaagaacaaaccactcgcttttcaaatttggatcgtcatctctggtattttactcaccatctcgattgtcctgatcattctattttccaatacattacgtaactttttcacgaatgaaatttataaaaatatcgaaaatgaacaacaggtgctcacagaatatccgttgaaccgagacggctcgccaaagtcgacaccggaaaaccgctcggtgcagcacattctgattccgtcagatgaattaaaccaaatgacgcagtttttcccgcacgcttttattgagaaaatccaagcctttgtgaaaaaacaaaaaagcgcaacgaaacgctattctgaagaggtgaatggccagcacatcttttttgtcatcaaaaaagtatcaacaggcaatacccaatatattcttttgtcttatgcgccagactcttatcgagatgacctgtcctttacgctgtttaaacagctgatctttatcttgggcaccgttattttattaagctggattccatcgatttggcttgcccgctacttatcccgtccaatcgttgcatttgaaaagcacgtgaagcggattgcacaagaggactgggacgatcctgtcatcgttgaccggcaagatgagatcggaaagcttggtcacaccattgaagaaatgagacaaaaactcattcaaaaggatgaaacagaacggactcttttgcaaaatatatcacatgacttaaagacacctgtcatggtcatccgcggctatacgcagtcaattaaagatggtatttttcctaagggagatcttgaacaaacggtggaagtcattgaaggtgaagcggaaaagcttgagaagaaaatcaaggatttgctgtacttaacaaagcttgattatttatcaaatcaacaccctgcacatgcttccttcctactcagtaatacgatgctggaagtggtcgaccggatacgctggtcgaaaaatgaattgcagtggaacgtggacttagatgatgaggctgctcttgaaggcgatccagaacaatggagcaaattatttgagaatgtactagaaaatcaacttcgctacgcaaaaagtaaaattgatattcatatgaaacaggaagaggatcaaatacgcattgtcattcgtaatgacggtcctccaattgaagaacatatgctatccaacctatacgaaccttttagtaagggaaaaaagggcgaattcggtattggattaagcattgtcaaaaaaattctctccatgcatcaagcatctatatctattgaaaatgatgaactaggtgtacgttatacgatcacggttccaaagaagagactgtaggtttttgaccgcagtcttttttagatgaatgaatacccattaaaatcacggtatgtggctttaattttcttgccagcttgatacatccatttcttttcaatggttgtctctttcggcattttgactttttctacttgaattccttttgttcgcaagcgtcttatcatatcatcgatttctctcatggaacatcatcctttcacatattttgaccagttggtcaccttactttataatataaagaattacactgtaaaaaacaagttacaatctgattaatttttgaaaactttcgtcgtttatgaccgataagtcacatctctttgcgcacgtttcctaagacatttgtctctcggtaagaaaggatgacattcatattgaaaaagaaagagaaaatgatcattgaggctggtatgaaattgtttgccagcaaaggctacaatacaacgtctgttcaggaaattgcggatgaatgccacatgtcaaagggtgctttttatctttattttaaatcaaaggaagcactgctcatttcaatcttacattactattatgataaggtatttacccggattcatgaggttcaaacagagggcggcacaccaaaggaagcctaccgtaaacagctcactgtctactacgataatattttgcagcaaaaggattttattaaaatgcagctaagtgatcgagcattgccaatgaatgaagatacgcagcagctcgcaaaacaaatcagacttgccaccattcagcttcacattgataacattaagcaagtatatggagatgcagcgattccttatatggctgatctttgtttgacgattgagggcatgagccacgtatatttcgagcttgcgattttatatgattttcagctggaggctgaggagctagccgcaacgatgattcaccgtattgatgatttgatgggcggtatgatggagcgacatgatcttccgctcatctctgtagatcaagcgagcgattggtttggtcctatttatgaacggtcattcgacccgctgacagaatctcttttaaaagaactaagagagcaggctgaggcacactatgaagtgaaagacgagcctgatttatttgaagcacttggcattttagaaaatgaattaaacaaacagaaacctagacaagttatcgtgaaaggcatgctgcatcaattaaaattatacacaccgctccgaacccactccgaatcacttttgcgtattttgaaagaggaccatttgtagaacccaaggcattccttgggtttcatttttgttcacatcacattcaatgaaaaaaaccaggggcagccgcccctggcttcttattttgctttcggtgtcaccatttcttctggtttcacaaactcttcaaactgctcttctgttaacagctctaattgaagtgctgcttcttttaacgttaaaccttctttgtgagcaagctttgcaattttcgctgcattttcatatccgatgtgcgggttaagtgccgtcacaagcatcaatgaattgttcaagtttttctcgattgtttctaggtttggttcgattccaatggcacatttgtcatggaatgagttcatgccatcagcaagtaattcaactgattgcaagaagttatagatgatgaccggcttaaatacgttcagctcaaaatttccttggctggcagcaaaaccgatcgttgcatcattccccataatttgtgctgcaatcattgttaaagcttcactttgagttgggttcactttacctggcataatggagcttcctggctcattttcaggaatgatcaattcaccaattccgcagcgtggaccacttgccagccatctcacatcgttggcaattttcattaaatcagctgcaagtgcttttagggcaccgtgtgcatacgtaatttcatcatggcttgtcagcgcatggaatttgtttggtgaagaattgaaattttgacctgtcagcttgctgatttcttcagcgacatattgaccaaactcaggatgtgcgttaattcctgtaccaacagctgtgccaccaatcgcaagctctctcattttttcagttgattctagaatcatttcttttgaacggtccagcatgtacacccagccgctaatttcttgacctactgtcagtggtgttgcgtcttgcaaatgcgtacgaccaattttcacaatttcttgatatgcttttgctttctcatcaagagtcgctctcaattgatcaatcgcaggcaataactttttgtacacagctaaaacagctgccacgtgcatagcagttgggaatgtgtcatttgagctttgactgcggttgacgtcatcattcgggtgaatgctgaactcactatttttatctttcaagtaagcagttgctctatttgcaacgacttcgttcatattcatgttactttgtgtcccgctacctgtctgccatacaacaagcgggaaatgctcgtcatactttccgctgatgatgtcatcacatacagcagcaattgcttctgctttttcgctctcaaggttgccaagacgttcgttggcaatcgctgtgctacgtttcaaaattgcaaacgcattcacaacttcctttggcattttctcagaaccgattttgaaattttctttgcttcgttgtgtttgtgcaccccagaacttgtcctttggcaccttgatttcgcccattgtatctttttcgattctaaattctgtcattatgtatccctccatagcttctatacactcaactctattctatacaaaaaaccaaaatcctttaagcgttttcaattaaaattttatctttattttaattttagttcaatataaacgcggacatctttcgaatatttgtattttgggttcgtttttccgtaatcttttgatgtatatgtcacttcataatgcttgtcaaacgactgtagaatacggtcaatctcctcttttgttcctgctaaacgaatttgtgccatcttgtgtcctccaaaaccctcattctttcttttaccacaaaataatgtaacacagaatattgttttttcaagcaggtaatgctaagaaaaagttatttgaggcgggtgatccatttgaatcaaactccactgaaagagcacttatacgataatctctctgtcatcctcccgcagttaaaggatatggacgatttgattcatgagaaaaaaacgctgcctcacgggcaagttgtttactatttatacataaaagaaatgaacaaaaagatggagattcaaacctttttaaagctgcttctccaagatcatgcgtctcttacaaaagaaaagttggaatctaatttatccatgatgaccactcgttcggttaagacctctgaagaattgattgatgcgatttttgaaggtcactgcgtggtgctgattaacggatttcagcatgcttatatattagaaacaaacggaacgaagaaacgcaatttaggggattctacctctgaaacagtcgtaagaggacccaaaattggctttattgaagatttaaatacgaatttagcgcttgtaagacagcgcttaaaaaaccctgatgtcaaaaccgtcgatatgaagattggtttacagaaatacacacaggtgaccatcatgtacatcgacggtatcgtacaagtacctgttttaaaggaagtcaaaaagcggctcaagcaagtcaccattgatgatatacaggactctggtgttcttgaggagctcattgaagacaatgtgtactctccttttccacaaattcaaaacacagaacggccagataaagtcgcgtctgctttaaacaatggccgggtcgccatttttgtcgatcactcaccttttgtgttaattgtacctgcttcgctcgccacaattatgcaatcacctgatgattattatgaacggtggatcgctgcctctctcattcggatgctgcggttcacctcgatctttctgacattatttttatcagccatttatattgcgcttgtgtccttccatcaagggcttttaccaacaactcttgctatttcaatctcaagtacgagagaaaatgtcccctttccgcctattgtggaggcgcttatcatggagatcacaattgaactgctgcgggaagccggtttaaggctgccaaatccgctcggtcaaacgattggacttgttggcggggttgttattggacaggcggccgttcaggcacatattgtgagctcgatcatggtgattatcgtcagtgtgatggcccttgcgtcctttactgttcctcaatacgggatgggcatgtcctttcgtgtgctccgctttgtgtccatgtttgctgcggctacctttggtttatatgggattgtgctgtttatgctcgtactccttacccatctcacacgtcaaaaaagttttggcacaccgtatttctcaccagattttgtgttcagctataaaaacgaggacaattccattattcgattgcccttaaaaaatcaacagaaaggagaacgagatggtcaatcataaagagtcgatatcaagctatcaggcaagtgccattattgcgaatataacactaggcgcaagtatgatgattctgccacgttcaatggctcaggctgcgactacacctgacggctggattgcactcttactcatgagtgtcatttacattgtgtttatttttgcaaatgtcatgatgatgaaaaaagtacctttctcctcatattatgattatacgaatgagggacttggaaaatggattggcgcgcttgccaacctcttgattattatttattttcttggcgttgccagctatgaagtacgggctatgtcggaaatggtgaagttctttctgcttcaaaacacacctgtagcaatgacaatgatcagctttattttggttggtttttatcttgccattggaggaatcggtgatttagccaggctatttccttttattctgattgtgacgctcatcatcttatttgtcgcttacggactgagcgtgcaggaatttaagctagataaccttcgtcccgttttaggagagggattcacccctgtcttcaaatccttgaacgcatcagccatttcgtttgtaggcattgaaatgatgctgtttatgcctgcctatttgaacacgcaaaaacacaccttcgcttatggtacagtcggctttttgattcctgcgattatttatattttcacttatattcttgtgattggtgcgctgactgtcaaagaaacagcgactttgacttggccgaccattgccttatttcaatcttttgatattcaaggaatttttattgagcgaattgactcctttttgcttatcgtttggttggttcagctttatacaagctttgtcggatatacattttttgctgcaatcggggtgtctaaactgaccaagtttcctaaacaagtggtccttgttttaatgggaattgtcatttactttgcagcgatttttccaaaggatgtcgatacagtgcgaaattatttaacctatgtgaacaacctctttttcctgctgttcggcattctcccgtttctcttatttatcatcgtgtttttcaaaaggaggcggaacacaacatgaaaaagaaagcagctgttgctcttttgacgctggttctattaagtggttgctgggatagcacaaatattgaggagcttaacatggcgattggatttgcagtagacaaaggggaccaagggaataaattaaaggtatctatgcaagtcctcgttcctcaaaagatctctcaggaatcaaacatcaaagaccctacgaaaatcattgaaacaaacggggattctgtgcatcaaatattccgcacaacggcgctgaaaagccatcgcattttcgcacagcagctacgggtgtttttgttttctgaggaactcatcaatgagaataatttcgacctcgtcattaatcaattcattcgagacaatgaaacgaggagaggaggcctcgtctttatgacctctaagaatcctggagacatgctgaaaatcaatgacgacggacagccagcctctacgaccttatacgatctttctgagaatagaaaatcgaccattcgcatgtttaagactagctcattaggagatatttcttctgccatgcaaaacaatgtatctttcgctattccgaaagtcagcgtcgatcaaggaaaattaatgatcgatggagcctctattattaagaataagcgatttctcaccaatatctctccgttagcagtacagtcatacaatctgttaactggagacggactgggtggagtcattgaatttgaatatgaacacagcatctactcttttgagattttcaaactcaagcaccatattaaaaccaataaatcagccagcggaaaatatcaatttgatgtgtcagtggaacttgatggacgattgtctgaggattggaatgaacgtgagaacgcttttaatgaaaagtatctcagagaaattgaaggcgttgtcaagcggcgaatagagacaagcgttaaagatttcatcggtgaattacagcatgagatcaaagctgatatttgcgggttctatcagaaggcgagtattgcttacccgaaggattttcgaaaagatgcaaaacattgggatgaaatttttagtgaatcagatattcagtacaaagcaaatgtgaaaatccgtgacttcgggactaagggcgcaacacaatccttatagagtatgttaaaatggtaagaaaaaaagggtgtcaatcatgaaacgagctttactttcggccggcattctatttttgattctaggaatactcctgttagtcgttgtattcatgcaatcaaaagaagatttcttcattgaagccgacagcttttcgagcacatttttgatcgtgatctattatggacaaacccctgcgctccttcttattggaggcggtatattcgtcggactttcacagatcattggtttgcaagagaaaaagacagctttggcaaaggagagcgtaaagctattatccgagatgaagaaagccctagaagacaaatcggccgaggagcaggaggcttttccagttcctgagctccatcaactatccgaacgtccgatcacaggacagaaggactaaacttacgcatgttctagcagctttcttttgaaagctgtttttttattttattggatcagcttatgacgatgtgcatacacagccgcttgcgtccggtcttctacatcgagtttggaaagaatgttcgtaatatgtgtcttcactgttttaattgtaataaatagttcctcagcgatgaccttattcgatttcccatcggcaatcagcttcaagatttccatttcccttgctgttaatgcatcatgaaggatcgatccatttgaggaatgacgaagtttattcatcacctttccagctacttttgattctagtcttggttcgccgatacttgcagaccgaatggcatctgcaatttctcctgccttggatgtttttaataaataacttaacgcacctgcctcaatcactggataaactttatcatcgtcaataaagctcgtcagaacgataattctagcatcttcaatttcctgacaaattcttttcgttgcttcgatgccatccatgccttccatgacaagatccattaaaatgacatctggccgtaattcaactgctagctctacacctttttgtccatctgacgcttcaccaatgacttcaatatcagcctgtgcctctaaaaaagcagcaagccccattctcaccatttcgtgatcgtcaattaaaagcactcgaatcatcgaacgttctctccttttccttcatcaaaaatgggaaccttcacatcaatttgtgttccttttccttcaaatgacataatctctgcgacaccgcctacttcacttgttctttcacgaattgattccagtccgtaggaggccgtcttcacatgatcggtttgaaagccgatcccattgtcgataatcttcagctgcacctgccgatttcgaatgagcagacgcaccgtcacctttgtcgcctttgcatgcctgaacacatttgacagggcttcctgtacaattcggaagaggtgatcctctactccttttgagagcggtacatcatcttctatttcccaatcaatatcaatcggctgctttgcttgaaattcatttaggagttcaatcaagccttttttcaagtcttttccttcaagggtgatcggtctgagatgtagcaaaagcgcacgcatttcattctgtgcatcgccagccattcgttcgactaagcgcatctgctttaaaatcttttcatccttttccttcatgccttcaagaatcgcagaggtcatcattgaaattgcaaacaactgctggctgaccgcatcatgcagttctcgtgctagacgctgacgttcttcggagacgaccgattttttcatttgcacctgccattctgcccgctcattcgagagcttttgcaaagaggctacttgaccttctactcgtttcgccatttcatttaattggtctgccgctaagccaatttcatcgtcgccaagagacggcagtctgtatgcaaagttcccattttcaaactttaaaatcgactctacaagctgatcaagacgctttttatgctgatagccaaatacatgtgaggcagaaaccccaatggcaagactaatgatcagtaaaatacaaaaaaacgggatgccgaaccagcgggtagagaggagaatcatcggatcaagctgataataaaaaaacatgggcagcatcgtcatgatgacaacaccaagcgagatccctactccaagacgaatagattgccactggatacctagatggagtttcctcataagtatctcacatccacatctccgatcagtaaagagatggagattttcacttttcgtttgctctcatcgtaattgtcggtcatcacatacactttacttccgaatccgcttcttttttcatcaataatcttcatatcaccaatggcagccgaagcactcacacatacttcaatatcctgcggcacgaaaatatccacatccccgatgagcccgcttattacgatcgtgctctcttcttctgcgatgatggcctttgataagtcgattttgacatcgccgataaaccctgaaatcgtcagatcacttaattgaaacggctttttcatcagtctgacttcaccgataaagaagtcatgctccttgcgcggctttgtctggctttttgttttcttttgctcgccctctttttcaagattgactttcagagaaggcttatcgctctccggtgcttcctttttatcgacatcaaaaacgggtttgtttttcaataagcgatagccggcatatatcaaaaaggccgcaaataaatatcctgtgagactaaacgtaatattgagcaggaattttaaaaagagaaagccggcaaaaatataggaaactgaaccgagccaacgtttggatcttgagtgcagccaatagcccgcaagcgcaaaaaacacaggccaaaacaaatcggctccgatcccaataattttgagaaatagattaataccaaaaatcacgacaatgatgcctaaaatttgattccttgaaaaacgcagttgactcgcctccttcctttgtttcgttcattaccgcagctttaagtttccacttgtcatttcaatatcgactaagtgtgtcccttttccccgcgtgcctgtaaagcctcgaccttcactatctgcttgatcaaagtgataggtgtgatcgacacttccacttgtttttttcacttggacattaaaatctccttcatccggcaggttaaattttgcgctgcctgatgtcatgtgaaaggagacaggtgattcaatggtatcaaagcttgccgtcaatctaccactcgtcatttctagctgcatttcccctttgacatctttaatatcggcacgccctgaggttgctccaatatcgctatttttcgcatcgatgtgagacacagagagtctgccagatgtcgctttgatttcgacattgtttgctgagaaattctcggcattgaggtttccgcttgttgatttgaggatcacatcttcaagtgccagcttcccttcgccgtcaatctcactgaccccgcttccacccgtaatcttcacatttttatgataatctgttggcattttgactaagagttctcctttttcaaatgaagtgaaaaacaagaatcctttattttcagcacggatgttaaatgtactgcctgattgttccgcatacattttcccttttccacctacgaccatcacggaaatatcggaacgattttcaggctgtaccttcacgcgaaatccagaaagagaaatatctaattgatcaatttcatcttttttcgctgaagctgttgtgactggtttttcacgggagaaactcaaatgaaagagattttcgtttttgaaaagcatcccaatcattaaaaagacacctacgagtatacaaattagaccaattaatcgcttcattcataccatccctttatcttctgaccttttcattataaggaaaagcgaaacagaaagaaatcaaatatcggaagaaaaatcctgcttttcttccgacctgtctctgatttcttagtttgcttgcttctgctcaggcttcttctccagcttgagcttttgccattctttttcaacctcatctgcatagtctaggtgagcatatgccccttgatctgcaaattgtgcatagctgcctgcttttgtctccatttcttcgatacggttctccattcgaagaaattctttatatgcactttcactatctactttattcatagattcgttcatatgctgctttgcctgtgcggcatttgctcttgctatgagcgcctgcttcttgtctttaatatcacgcagcttcgtttctaactgctgcaattgctcttttagctcctttagttgtttcacagattgctgataagcttcctgatattccaaatgcttttcttcaaaatacttcatttctgtgagcgcttttcgagctaactcttcttctcctgcgtgaaatgccagctcagcctgcttctttcttttttcagcaaatgcttccgtctcttctgctttgcgcaggaaaccttgttgaatcgtttgctgtttgatgatcgcatgtttcgctttggcaatatcgtcctccatatcacgaacgtactgatttagcatgacacgcgggttctccattttatctaagccctcattgaccgttgcaacaaacatatctctcattcttctaaataccatttgaatttcctcctcttattttttctttaaaaagtcttcccattcttgatcaaatgacgtatgcataggttcttccattttcggggacgtgtttggctccatatatgatctgcttgatgatccttttgccacttcaccattgatcatcgtccagccgaagtagagaagccccccagctagtgcgattccaaggataaatggcagagcttgcacaacgatcatgacaccaatgactgctagaatgacgccgaaggttttactaccttgctcatatttctttacacctacatagatgagccacgccccaatcagaatcgggatcagccctcctagtgaaccaccgaagaagatggatagaccgacaaacattaaaatcgaaccgatgatggttttacttgttattttcatcttcatgcctcctttcttgctccttgcttttactatagtcaaaaaagaaagctggcaaaacgtgtcgcagattgatctttcattgcgaccagagtcgtaacttcgctcagactgagcggtagaatccaataaaaaagcactcttcaatgagaagagtgcttttctttatttagaccgaaatacgtttgcacttcgttcatattcaacatccgcttcaccgagtcgatgattcacgattcgggcggctgcaaataaatagtcagatagccggtttacatatgtgagcgcaactgatggaatcttctcctgcttcgcaagcgtcaccatatgccgctctgctcttctgacgactgtccgcgccacatgtaagagagctgcgccttcctggccgcctggtaaaataaacttcgtgagcggcgcggcttcttctacatagacatccattctttgctcaaggactgtcacagaggcttccgttaatttaccttctttcggtggtttcactgctgctaaatcaccgccgcagtcaaacagctcgtgctgtatcacaatcagctctgacaaaatgtcatgaaacaattcgccatgctgacgtaattttgcatgtgcgagtccaataaagctattcgcctcatctaacgtgccataagcctctactctcacatcatccttatcggctctcccgccgatcaagcctgtttgaccttgatcccctgtttttgtataaagtttcattggtgttcctccttctctattgctttgtccttttagtataacctgaagtgaaaaggatgtatttgtttaactaaagcactgtgatgttcatcgcatcataaacaaaaaaagcgaaccctttggttcactttcaaatggcatttaatgaataaagaagacggtgcactttctgctttaatctttcgtgtaaatgctcatcatcttctgtttcttgcatacccgcagcagcgatacaaagatgatgaatggacatgctcgtctcctgtttcatcatatggacaagctgccccacaagctgaacagacgctccgtctgatatagactctttcagtacaagccaaatggtcagctctccttgatgacgcatgccgtaaagcaccatgtcgtcgtctgtgtcttcagcagcaaattgttttggtccacttgcttggtcgtaaaacaatagtccttcccgatcttccagctcatcttgaagcatctcacttcccgttccaagagaccttttccaaaagaagccgccctttttctgatgtgaggaaaggatgcgaagcggctgtttgagggaaaacgtcattccttctccgccatgcgttttccagccatccgctaactttgcatttgatgctacagaagcccccgcaggctcaatgatcacctgagggtttgcccttcgcggatgttggagcggtgttacatttgtttcatatacacggttgattcgctcaggcgtcaagacgtgatgcggcagccctgccatctctgcctttccttcatcaagtaggagcagtcgatcacaatacaaactggcgatgttcacatcatgaaacacaccgattaccgtcagcctagaggaagtggtctcttctttaattaaatcaagcaagtctttttgataagccaaatcaagaaaactggttggttcatccagcaataaatagtcaggctgctgggctaatgcctgtgccaagtacacacgctgctgttctcccccgcttagctcatgaatagattgatccttaaattgtgcaacatccgtttgttccattactttgttgatgatctgcatatcttctcgtgtaacagattgcagccatcctttttgatatggataacgaccgaattgaaccgtttcttccactgtaaatgagaaggcttggtccgttttctgcggtagaacagccattttttgcgcaagtgcctttggacggtaagattgaatcagttgaccgctcaggcgtacctcaccactgtcaggttccagcagcccagagatcattttaagcaaagtcgacttcccgcttccatttggaccaagtataccgagaaattccccttgctttacctcaagactgatgccgcgtatgacctctttctctccatatccacctttaatttccttcacttgaatcatagatgagtccctcctctatatttacgaatgaggatgatgccgaatacaggggcaccaattaacgctgtgatgatgccgatcggtaattcagtcggctcaatgatcgtacgcgataacacatctgctaaaacaagaaaggaagcgccattcagcatagacaaaggcaggaggtgccggtggtctgtgatagctaagaggcgaataaaatgcggaatcacaagtcccacaaatccgatcgttcctgataccgctaccgcacttccagtcagaattgatccagcaagcagcacgatatatttgctccttttcacatgtacacctaatagctttgccttctcctcgccatacgtcataacattcaaatctctccccatcagcattaatgcaaaggtgccaatcagaaagaaaggaaggaaaagcacaatatagcgccagcccctcatggacacactgccaagaagccaatgaataatctcttttagatcatcacccgttaaagcaatcatcaatgaaataagcgcgcccaaaaaagaactgaaaatcacccctgttaaaattaacgaggagatgctcatcccccgatgaacaagacgtgcaaaaaagaggacgagacataaggtcacaagtgctgttgtcatactgaaaaaaggcagtgtgaaactgccgagcaaagggagctgcaaactgaaaaatagggtcgcgacagctccaactgatgcaccttgagatacccccagtgtatatgggtcagcaagaggattttttaataagccttgaaaagctgctccagataacgccagcgctgctccgactagcgccgctaatatcactcttggcagccggatattcatcataatattgcgatcaattgaatctattgtgcctatctgcacaccgaatagttcgtgaacaaatatacggagaatagaaggaatgggaatccctaagcttccaaaggagattcccattccaatgctcaccacaagaagtaaagcacttagtgtgtatgcgatgatgaatttatttgaatgtgtcaggatagatgcttttcgcaagagcctcgactccttcaaccaatcgcggtcccggtcttgatgcgagatccgtattcaattgaaagacttgtttttccttcactgctttgatcgcattccagccgtctctctgtttcagatcagctaaactggtaccatcaattgtgacgattacgtcggggtttcgtttgataatcgattcttctgtcatttgcacccagccagtttgatcaccagcagcatttttcgcatggatcacagaaagcatttcgtccataaatgtatgagttcctgttgtataaatttcaggagtacctgatacctcaacaaagactgttttttgtttgtctttagagatcgcctctgcttgtttcttgatgttattcaattttgctttcatctcgtctacaagctttgttgatgcttcttttgcacctgttgcttcaccgatcatattgatcgatttgtacacatccttaaaggaagtggcatcatttacagtcagtacttgaatccctgcatcctctagctgtttaaatccatcttttgatcccatctgcgaggcatgagctagtaccagatcaggttttaaggaaatcaccttctcgacattgaattcaagtccgccaattttctctaccttttcaacttcctttggataattgtcaaaatcagatcgtccaaccattttatctccaagaccaagcgcataggcaacttctgtattacttggaattaatgaaacaattcgtttaggctgttctttgatgtcgactgttttaccagctgcatctttaatcgagacaggaaatgccgcagccgctgtttcgttattttgtgaactctttgctttatggtctgtttcagcacctgcacatcctgctaaaacacccatcacaagcaggagcgatagccaaatggccgttaactttttcatgaatgaaccccctgatttatgtactgcttgacgaaatctcttccgtcaattcttttctaatttcgggaatattatactacagtgcagataggttgtatatgtgatttctaaaagcgtctttttcgttctgatataagaaaaacagcctttaaaaagactgtttttcacccatctatttattaatttgttccccattgatgacgactttctgaaaagaaggcgctactgcatgctccaaagaaagcggatacgtcacatgatctatgacacaatttttcatattgaaatgggtcacaggagaatgtggataggcggctattttcacaccatatcttccgccgctgcttttcaatccttctacttcaatatgacgtacaacaggacgatgtggacccgcatccccttcctcatacatcatgtcgatacagatcacttcatgctttaggcttttgactgtgttgtttttaaagtaaatatgttcaatggtcccgcctctgacagagttggttttaatacgcagtgcccggtcaaggttcggactatccattacattattctctgcatagacatatcttaccccgccagagatttcactcccaatcgtcactccgccgtgtccatcacgcatctcatttctacgaatgacaatgttttcagacggaacccctattctccgtccgtcctcgttccttccagatttaatggcaatacaatcgtcgccattatcaaaataacaatcttcaatgagcacattccggcaagattccggattgacaccatctgtgtttggtccatgcccaataatatggactccacggacaatcacatgttcactcagtacagggtgaatttgccacatcggtgaatccttcactgtcactccctcaataagaacttgctgacattggtagggctggataaagcttgatcttaaataatgcccttctccaaactctctttcttctactggtattctcttttcagccatctcaaatagaagctgacgatccctatcttgagaaggctggccattcgtgccatatttccaaggccaccaatgatgctcatcccctccgccatcaagcgttccagctccagtaatggcgatgttttctgcatggtgtgcataaatgagaggtgaataattataaagctcaaccccttcatatcttgtcaggacaagcggcagataatcctttgggttttggctgaatgtcacatacgctttctcatgcaaatgcaattctacatgactcttcaattctagcgcacctgtcacaaacgtcccttccggaatcagcacacgtccccctttcaaacggtgcgcatcatcaatggcagactggatcgcatctgttgaaagctcgattccttttgcatctgcaccataatgaaccacattaaattcacgatcagggaacagcggtgcttttatctgttttaacacttgatggattccgtttgcctctttgtctttcttcccttgccttgctaaacgagtgagtccaatccccgtaagtaccgttcctgctgtgatatacatcaaatcccgttttctagacacattatcatcccccagtcgccttaaagtgtgacacctgttttgaaaatagccagctctctaaaattgtttttttcatgatttaatagctttccgctcgccacatcaatgaccgttgaaatgaatttttctaacacaatatcttctggtacatcttcaagcaattctcccgcattaaagtcaatccaatgtttttttgtttcatataaggctgtattcgtcgagactttcattgttgggacaaacgtgccgaatggtgtccctctacctgttgtaaaaagaaccaactgacagccagaagcggcaagagcagatgaagcaaccaaatcatttcccggggcacttaacaaatttaaaccctttcgcttcagcaattccccatatttcaatacatcttgaatgtcagaagttcctgctttttgtgtacaaccgagagatttatcctctaatgtcgaaattccacctgctttatttcccggggaaggattttcatatactggctgtcgatgatccatgaagtattgtttaaagtcattgatcatttgcacaatattgtcgaaagtcgcttctgattccgctctctccattaaaatcgtttctgctccaaacatttcgggcacttcagttaacactgtcgtgccgccttgagcaacaataaaatcggacagccttcctaaaagcggatttgcggtaattccggagaatccatctgatcccccgcacttcaagccgattttcagctcagataacgggatttcttcacggtgatcttctttcgctgcctcataaatttccttgagtaaagcaactcccgtctcaatctcatctcctacttcttggcttcttaaaaatttcactctctcacggtcatattcacctaatgtagactgaaaatggtcaatatcgttattttcacaaccaagtccgaggacaagcactcctccagcattgggatgcttcacggcattttgtaaaatggtttttgtattctcatgatcgtccccaagctgtgagcatccgtaattgtgctttaacacgagagctgtttcaaacggatggatgcttccgcccatttcagcggtaaaaatttgaatgatttgatcggcgatgccatttacgcatccaacggttgggacaatccaaagctcatttcgaatcccgctttccccattttttcgtttatatcctttaaatgtaaggttctttttttcataggggttatttgtaaaagaaggctcgtattcataatcgagcttgcctgataaattggttttgatgttatgtgtatgcacccactctccagcagaaatggcagtcgttgcatgcccaatagggtaaccgtatttcatgacattctctctttgcttgatatcagccaatgcaaacttatgacctttggcgatggtctcttttaaaataacggaatgatcttgatgatgtagctcctccccttgttcaagtacttttaaagcaataccgacattatctgaagggtgaatcacaataaaatctttcatgccttctccccctgactttcatattgatgttgtagcattcgttgaacagccgctctcatcccttgctcccttatgagggtaagctggtcagctacagcgtgaaccaaatcatttatatccgttaaatttctcccccataatttctcacatgatagaatctttgctgcgatcgtttcattagattggttctcttcttcaaaggcttccttcatgaatgccagtacagtctcatcatcctttatcttttctgcatgtgctctgtaaaaataaatgaggctgctgagtgaaaacacgagtttcattggcagctgtttcttttgctcaacataatcgagcaatgacggaagaatacgggttcgaaacttagatacaccattaagcgcaatatccagcaattgatgcttcacaaatggattgcaaaagcgatcccaaaccgattgtgtataaagaagaagctcatctcgagaaagctcaagccctggcagtacttcctcctccagcagccgccggatgaacgtgccgacatcctcatcatccacagcttcttttacagtttctaccccgcatgagtaagcgattggcaccattgctgtatgagcaccatttaaaatccgtaccttgctcatgcgataaggcgcaatatcctctacaaaaaggacatttaaacctgcttcttgaaagggaagctctttttgtacgaaggcaggtgcttcaataacaaaaaggtgatagtattctgccgtgacaagcaactcgtcgatgtatccctcttccttttggacaatttcagctgcttccttagaaaacccaggaacaatccgatcaacaagcgtattacaaaacgtattggcttccttgatccatgtgataaacgcaagcggcaaatcccactcagctgccatgtctatcacatattccttcaagcgatcaccgttatgttcgaccagttcacatggaaggatgatcagccctttttgttcatcaccagcaaatgctttaaacctgtgatataggaacgccgtcagctttcctggaaaactagcttgcggtcgatcctccaagcgatcggccttgctgaacataagtcctgcctctgtcgtgtttgagaagacaaagcgaagatcggggttttcagctacttgtaaaaaaacatcataatccgtatacgtactgattcctctgctgatcgattgaatgatcatgcgctcattcatttcttgctggtcatgatagccctgtatacataaagtgtataagccatcttgttcatttaaagctgcaacagatccttttctcggaggaacaactacagctcttcctttaaaatctgtgcagtcgttcagcttttgaatgtgccaattaataaagcctcgcataaaattcccttcaccgatctgcaaaatcgtttccggatactcaggcaccggatatatggtttttgataaacgtttcaaatgaattctcctctctgtaatttatgcacacgtgaacatccctctataaaagatgctgtttactgcatctttttgactgaatctctaatcatcagctctgtgtggacatacactttttccatatgatcttcttcttgcttttcaccgttaatgacggataggatggcctctgctccaagtgcacacattttttcgattggctttttcaccgttgtcagtgcaggcgtggtataggatgaaaatgcaatatcatcaaaaccgataatagagacatcgcccgggcacgtctttccctttgcatataaagcattcatcgcaccaatggccatgtcatcattagagcaaaaaagcgctgttggcggatgatcaagggtcagcagggattccattgattcatagccgcttttcatatggtagtcacccgcgatcatatattcttttttcataggaatatggtgatcaattaacgcttggagaaaaccagcttttctctcctgagtcgatttaaagccttcttttccttcaatgatggcgatttgttgatggccttgctgaatgaaatagtgcgctgcctggtatgctccttgactatcatctgctaatatattcatcacttcattactttctacacggcggttcagcacaatgattggaatgccctgtttcttgacatgatggataaacgcttcatcgtgctcactttggctcatcagcaaaatgccatcgtagcgctgcttatgaatggttgtgtaatcgtgaaaatcgtcaatacccctaacaaacaaattgtaatgctctgtcatgacgctattgacgccttttaaggcatccacaaagaagcttgaggatgtgccttctgttaaactcgtaaaaaacagaccgattgtaaacgatttttgtgatacaaggcctctggcatggacatttggtgaataattcagctgttttgcaatcgacaaaatcttttgttttgtcttctctttaataaaaggactgttattcaaagcccttgatactgtggtatgagagacatttgccaattttgctatgtctttaattgtgactgtcatgctattccgccttttatgatttttttccatcttatcataaaaccgctttcattttcttgtctttctcttcatgtgattttactttgatgatagagctgctttgcccggtcaaattgaaaatattgcttggcgttttcatagctgatacctttcacaatgtcccctaacagctcaaggtcatatgggacttctcctttttctacccaatccccgataacatcacaaagcagtcttcggaaatattcatgccttgtataggacaaaaagcttcttgaatcagtcagcattccgataaaacggctgatcagtccgatactggaaagagccatcatctgttctgtcattccttgtttcgtatcattaaaccaccaggctgtgccgtgctgcatcttccccggtgtcttcccgtcttgaaagcttccagccaatgttgatatcacgacattgtcccttggattcaaggaatacagaatcgtgtttggcaatgcatctttttgttctaaacgatctaatatgcggcaaagcggctttgcaatgtcttcgtcattcatcgcatcgtaccccgtatctggtccgagccgctcaaacattttcgtattgttatttctaagtgcattgatatgaagctgcattgcccagccacgctcacagtaagcctgacctagcataatgaatgtctctgttttaaatttgatcttctctttttccgtcaatggatgaccagacattcttttatgaaagatagtctccacttcttcttgtgtcgtttcttcatatgtcatttcattaatagcatgatccgagatcaagcagccgtgttcatggaaaaaatcaattctcgctctgagggcatgtaagaagtcttggtaggattgtattggaatagctgaagcctctgccagctcatgaacatatttttcaaacagatcattcgctatatctagagctttatcaggtcgaaaccctggaaggacttgtacagagaatccctcttcccgcagtttttgatgatattgaagtgaatcgaccggatcatctgttgtcacaacggtttcaacgtttgatttcatgatgaagtctctcgccccaaatccctctccttgcagcttttcattgactttctgccaaatgatatctgcatttttttcatttaataggtcttcgacttcgaaataccttctcagctctagatgggtccagtgatagagcggatttcctatggtcatagggacggtcttcgcccacgccaaaaatttatcatcatcagatgcatcacccgtgacgtgcgtttcaggaatgccatttgctctcatggcccgccatttgtaatgatctccataaagccatgcctcagtgatatttcggaaggttttattttcatagatgtctttaggacttaaatggcaatggtaatctatgattggaagatcctttgcaaactcatggtataacttttccgccgttggactgtttagtaaaaactgctcatctaaaaaggctttcatcaaattcccccatccctcttatcgtatgaaaatgatttgttcacgttaacaatttaattgtaatcgtttacaaagttgatttcaatcctaaaataggaaaaaacgatctccttcagaaaggaaaatcgttttttggctattttacagggggtgatttttttaggataatcgcaatagttgttccagcaccaggttcactttccacttgaatatcaccgtcatgcagtaagacaagctcttttgctattgccagaccaagtcctgttccattcgttgggtcatttgtatttgtccctctatagtagcggttaaataagtgatcgaccgtttcttgtgccattccgcatccgttgtctttcatttcgattcgaacttcttcatctgtttcagacaaaacagctgtaatatgcgtgccctttgggttatgcttgactgcattcgccagcaggttctcaatcactcgtctgaaccaagctttgtcgatctcaaagatgacaccgtttgtttgattttcaaaagaggttgaaaaatcctcagaaaaagagcttcttgaaaactcgtccattatagagcctaaaaactcatccagctcgaccggctttcgattaataggcaaggcaccatttttcaatcgatacgtgagatttaaatcttcaatcaaggtcgacatgtattctgatttctcacgaatcacctgtcccatttccatgacttcttccttggaccattgatattgatcagattcaagcatgagcccgtagccgtaaatggtactaagaggtgttttcaaatcatgagacaatcctgcaatccattcttctcttgtggtttgaatttttcttcggtttgcttcattctcttttaatgtaagcgtgagctgatccattgtttttaggatatcctcaaataatcggtattcccgcttaatacgaccttttttatttttactgattggaatcccttttctatttgttggttcctgtaatttatttctagataagaaaatcagccagcggataatgtgatagatcggcagaccatagcgatacgagtaccataatgtcatgacgataataaccgtaatcacaagacctgcaattaaaatggttgtatattgatttaaagcgtctgtttctttatcgtataatccatctgggctgtatactttatttggtacagaaataatgatatacagatttttattcactctaatataagacagatcacttctaaactcccaaggctttgattgatacttgagcagttcaacatctgttacatcatgtttcaaattggtattggttcgaatgccttttaaatatttcccttcatcattgaacaggtgcaccgacccattcattctcttcaagaattctttcgtttcaaccgaatattgagagagtgcagccaaatttttctcgttctgcttcaaataattggctacctttgtgctgtttgttttaaacccatatagcacgataaagcttttttgatcaatctcaattggccagaagtacatcttataatctttatattgccttttttcaaagatcctgatcatttcatccttttgataggatgttggaatggacttagggcggtgatagctatagacgttatgtttttttgaatcaatcacttgcagccagccgtctcgttttctcactgcttgcttgagctgatcatcggcttccatttctccatcctcgttaaaataaagccagctcatgagtgtatctccatcagcttttgttaaaccagtttcagccatgttctcgtagtatttttttaaatataaattatcagagaacgtatttccgattaacaaaatggcaatcacaataaacatttgtccgacaaagtgaaagaaaagttttgctcgtaaattcatgaattaatgatgaacctttactgggtgtggtataaatttatatcccattccacggatcgtcacaatatattcgggctgactcggatctaactcgatcttttctctcagctttcgaatatgaaccatgacggtgttgttatcaccatatgatggaacgccccatactttctcatagatttgatcttttgaaagaaccacattcggatgatcacaaaagtacttcagcaaagaaagaagctgagcagagcatgcagtcacctttcctcttactttcaattcagctgaatgaggatgataagagaaatgagcatattcatattgactttgagcctcttcttgctcttcctttaaagagatatatgttcggtttaagtgagccttaattctagccacaagctctagcggattaaatggctttgtgatgtaatcatctgccccttgagcaaaaccggtcagtttatctacatcagacgttcttgcagttaaatagaaaatgggtgctttcgtatattttctcatttcaggaagaacatcaaaaccagacttaccgggcatcatcacatctagaagtaagaggtggatgtcctcgtttttgacaacatctaatgcttcatctgcatggtaggctttatatatatgcttgaaaccttctttttttaatacgcgttcaaccattttgacaattgcttcttcgtcatctgcaatcaatatttttgctgtttccacgcatctctttcctttctagctatgatctctaaccgtatattaccattgtctaaagtaaaaaagtacctcttttctgcataaaagcgaaaaaatatcaactgggaaaaatggtggtactaggaagtttcagagacgcaaaaaaactcggctattccaccgagttccttttacttctattatccattcacagcttctagctttctttcatggttcaccaaatcatatgttaaacagatcggcttattcgttctaggatcaagtacgatttctgcatcaatgtggaatacctgaccaagcacctctttggtcatgacctcatgaggcgtcccatctttgatgacttttccttgattgagagcaatcatgtaatgagaaaaacgtgccgcatgattcaaatcatgaatgaccatcaacacagttcgtccctgttctctgtttaaccgttctagcagctgaagaatctcgagctgatgtgccaggtccaaatacgtcgtcggctcatccaatagaagcagttctgtttcctgggcaagtgccattgcaatccatacacgctgacgctgtccaccagaaagtgcttcaattggtctgtcatgaaaagcaatcatgcccgtttcctcaagtgcccatctgatgattcgtttatcttcatttgataagcgaccaaatccattttgatgtgggaaacgtccatatgacaccagctcatacactgtcagtccgcttggtgcttcgggtgtttgcggtaggatcgccatttgttttgaaatttcttttgtaggcgtttgatgaatagcctgaccatttaagtaaacagcgccttgattggacttcatgatacgggacattgtttttaaaatcgttgatttcccgcacccattcggtccgatcaatgttgtcaccttgccttttgggatactgatatttaaatcctctacaatcaaacggtcctgataaccgatacatagcttttctgtttcaagcgatttcatatgtttttctcctccctcattagttcgttttcatcaataagtaaatgaagtaaggtgcacctaaagcagaaacgacgagaccaactggcacctctgatggtgcaagtatgacacggccgagtgtatctgccagtaataataacagtgcgccaatcaacgcggaggctggtatcattccttggtgctttggtccaacaagctttctcgccaagtgcggtgcggctaaccctaagaaagagatactccctgcaacagcgacacttgcacctgctaatgcaacggcaatcagcatcataaagcttctttctttatgaactgaaatccctaatccataggacagctggtcacctaaattcatgatatttaagtagcgtgctctcacaagcgctaacacaaggaaaataagcatccatggcagaactgataggacatacgtccagcttgagccccaaatgcttcctgataaccacacaatggcttggttaaaatcatttgggctcatttttaattgaatgaccacaattgctgctgaaaacgcagcattgacgccaatacccgttaaaatcaagcgaacaggtgtgatgccttttttccacgctaacacatagatgagaaatgcagcaaaggctgcacctgcaaatgcgaaaagcggcagtacaaaaatcgtcaaatgacctaagttcgacatcgtgccttgaaatgcaaagataaaaagcacaacagcaaaccctgcgcccgcatttacaccaagaataccaggatcagctaagccgttttgagaaacaccttgccagatagctcctgaaacagcaatagaagcaccaacaagtaaagcgatgatcattcttggaagtctaaattcgaacagcaccagctcatccatttcacttccgagtccaaaaaatgttttcaatgtatctatcggagaaatacgaatttctccggtatttaaactaatcaaaaatacgacgacgatggctaaaaagatcatcagcatcgttcgtttatatttctttctctttgccagctgcaccatttccatttaaattccgctcctttcacgtctagctaagtataagaagaaaggaacgcctataatcgcagtaatggcaccaactggtgtttcaaatggagcattgaccagtcttgcagcaacgtctgcataaattaacaagatggcccctaaaatagctgagcaagggatgatccaccggtagtccactccgaccaagaatcgagtgacatggggaatgacaagcccgataaagccaattgagcctgccactgacacagcagcaccggttaaaagaatcacgaccaatattcctagcaccttgaccgttttcgtatactgcccgagccctttagccaattcatcacctaagctcagtacagtgatcgagcgagcaaggatcatcgcaatcacaagccctacgatggcgactggaataacgacctgaatgttgctccaattcaagcctgccacgccgcctgcgtaccaaaaactcatgtcttgagcgacgtcaaaccgaatggcaattgctgaagagatcgagcttaaaagagctccaaccgccgtacccgctagtgcgagcttcactggggttagtcctcccttagacagggtaccgacaccaaacacaatagatgcaccgagtgcggctccagcaaatgaccaaagaattaatgtgaaagatgattggcctgggaaaaatgcaaatgctatcgcaatcgcaaatgcagagccatttgtcacacccataatttcaggagacgcaagcgcatttcttgtcatcccttgcataatggcaccagatacagctaaaaaggcaccgacgagtgcagccccaactgtacgcggcagcctcaattcccgaatgatttgatgtgaagtttgttgtggatcaaaatgaaaaatggcttcccataccgtgtgtagatgaatatttgctgctcctaatgataccgataaaaaaagaccaaatgctaaagcgatgattcctatgatgacaacagctgctgttccaaaaggcttcgtgacaatatccattgcatcgtccttggctggcagctgcttattcgattgtgagcccaaaaccagtctcttcctttccgttcatatctattccttatcagtgataatgattatcaatctcgaagtctagtatatcattttctttcctttttgaaatcattgttctgaacattttctttattttcatcaaaaaaccgggagaaattcaccatttttctttaggtcctaacatagccgatgcatttttcattccatcatgttacgatataattgaaattgagaatcattatcacaataacgtgaataggagagaatctttgtgaaaaaacgatctggatttcttttgatatccttagcctttctcatgctttttacagctgcttgcagcggcacttcaaataaaaaatctggcgccaaccaggatgacacaatcacctatcaggacgtgaaaggcgaagtcaaaatccctaaagatccaaaacgaattgtgcttttggcagaaagctactacggtgacctcgtgacacttggcaagacgccgattgctacaactgcccccatctttaaaaaccctttctataaaggccaaacagatggtgtcaaaaaccttggaacatccccttctgttgaaaaggtcgccgctttgaagccagatatgattattgcttggggagaagacgagaaatttgatcaatacaaaaaaattgcgccaaccgttgccattaaatacaatcaatattcctttaaagatcagctgaaagaattcggtaaaatgacaggtacaccgaaaaaagcagcagaatggatcacaaaatgggatacaaaaatagctgaggtaaagcctaaagtaacaaaagcggtcggcagcaaaaccgtttcaatcgtgtcaccctttgataaaggtatctatatctttggaaacacctttgcacgcggaggcgaaattatttatgacgagctgaaattacgtgcgccaaaggcagttaaaaaagatgccatcgacagcggcgtcggctatgcaaacatttcccttgaaaagctgccagaatacgcaggcgactatattttcactagtccatggagcggttcaaaaagtaaaggagaccaggtgtatgaaagcagcatttgggcatcacttcctgctgtacaaaataaacacgtatttgaaatcgatcctgtcggttacttctttaatgacccagtgtcaatagaaggacagcttgagtttattgtggaccgtttaacatctgaatcataaaaaaacgtttctccatatacggagaaacgtttcccttataccgttcctttggcaaatccttttgacatcaatggataaagcaaaatacctactaagaacagaccgatgccaagtccaaatgttttaaaatcagctgttcctgaaataatgacccaagcggaataccccatcgcaacaagcgcaatgattccgtctcttgttcgcttccctttttgaagatcatacgtgtcaccttgcatgatgactttaaagctatagatcgaagacacaatatacggaatgagatacgcaagtgtcgctgatgtcgttaaaaaggtaaaagcttcattaatcgtacgagacatcactgagaaaataaacagctgtgacataatgtttgtaaccgttaaagcaaaaacaggactgccttttttgtttgtttttgcaaatactgccgggaaatcgccagcctttgctgcttgatacggtacttctgaaccaagtaagatccagccaagcatcgagccaaataaacaaataatcgcaagcaatgccattacaattccgccagccggcccaataataagctgaagcacgtcaacgaatggtttatctgagccttgcaactgatcgtgcggcaggacgcccattgtaatcaaagtaataatcatgtagatagaaagtgcaattaaaagtcctgtaatcgttgcacgtttcacatcgcgctgcgaggacgctcttcctgataaaatgacagcagactcgatgccaataaatgcccatagtgtggaaatggccgcatgatgaatttggcccccaagtccgagcattccttcgccctctgctgcaactgggaagtaataatgttcaaataatgccgtttggaatgcaaataaccctgcaacaataaaaaggacaaatccaagtacctttgaaaaggtcgtaataaagtttaatttacttgcagcacttaagcttgtaattaagatcgtatgtgttccccaaagaagaatggtacatacaataaacgttgtcagctgacctagtgttatcgcttctttaccaaaggtgaaaatttccgtcttcacggtgagaatggggaaaaatgtcgttaaataaccggcaagactcgtaataatcgcgacattactaatccagcttgctacccaatatccccaaaccattgtaaaaccagccgctttcccttttttcggatcgttaaaaagcgctcttgcataactttgtggtccagccgtcagctgaggcttatgaatggacaaatgcccaaaaacaagtgcaatcatcagcacaccgccacctgtgacaagccatgccatcgtcacacctaaaggactcgcatgctgggcaagcgtacttggcagcataaagatgcctgaacccaccatatttccgacgacaaaagccgtcaataaccaaaaaccccatttttttgtctgttccatttccgtacctccgttatattcacttcggaccagacccggcagtatcttcattgatatatttgtgaagcaatgacttgtattctttatgttcattatgggtcactttcttaacagcatacccttatcttcggtactcagaacataaaaaaaagcctgaacaacagtccatgcttttcaaaacatacaccttgatctccggatagccctccacgcttcaaagacgtggcagtcctgcatttattcaatgcagacccagcataaagaaagttggagctctctctacacttcggcgctgatgccttttttctcatgatcttcgattccatctctcccatgagtgactcatcatccgcgcaacctctacctcactgagacatagcgtgaggatttctattcatttttactacacgaaggttatcaaacattctcacttctgtcaaagggaaaaacatagaaaaagggcagagatctttttctctaccctatacctgcttattgatcgttgtttttcttcttttgtacagcttcctgaagcggatcgcctgctagctctttgcttgcttcttctaacagctgatctacttgcttgtggtctttctcgcttttcgcctttttatccttttggaaaaatgacatcgctgtttcctcccttttcataaaatgcggttgcctgtttaatttgtgctacagttcgccgcattatacaaagtggaaagagctcaatcatcatgaaaggtctgtctcattttttgcagatatgtcaaaaaggtctttaagtcttcctttgtgaagtctgacatcatatgctgaatcacctttccgaaaagacgtgtatgcttttcataaatcgcctgccctttttcggtggcttctaatcggacgagcgaggggtcatctttgtcccgttctctctgaatatagccctgctcacataatttattgagtgcaatggaggctgcacctgggtttaaagagagcctttgtttcagctcttcggcatgtgatacttttccttgtatcaaaatagtaagagcatatatctgcggaggcgtgatgtctttttctaactcaagtaacttgcggtttaatttacggctgacttcataatgtacaagaacaatttcttttaaaatgtctgcattacccatccgaatcgcatccttatcgttagtatcaacttgacttcctccttattatagaatgttttaccaatcagccaacccttttgtcctttttttctttagaaataagccttgctgaatgaattcacccttgatatagtgaatacttgaacaaaaaatagaacaggagtacgcatcatgacaggaaaaacacacattatgggcggaatcgccgcctcaacggccgtcgcctactactacggatttgacccagtcatcatggctgcagctggatcagcaggtgctttgatccccgatctttgccatacaaaaagtaaaatcggtagaaaatttccgctgctctcggccctgatcagcagcgtgttcggtcatcgcacgtttactcacagtttattatttctgctgatcatttattttctcgcaacaacatacattccaaatgacagcctaagtattggtttattagttggaatgacgagccatcttatccttgatgctggaacagtaaacggcattaaatttttatttccagcttccattaaagtgcgtctccccttctatgtcaaaacaggcagcacaggagaacaagttgtactagctgctctcactgtcgtcacctgctattacatcgcagtcatctgcggcatgtctatccccatccagttctaacagaataaaaaagagttttgcgaaaaagataagatatgaattgatcattcctcatttttttagtaggtttaagataagtgtttttgccttgcagctgaatacagaatggtgaggagatacatagatgaaagcgtttttcaaaaatcactggtttttagtgtattccatcctcttcatgtggatgaaaacatacatcatttatcaactaggttttcacatacgaacagccaatctgtttcatgaatggctgcttttgatcaatccacttagctttctactccctttgtttgggatagctctttttttaaatgaaaccaaacaaaaggtttttttattgactgcaaattttattctcacggcgattcttatatcgaatacgatcttttacggtttttatattgatttcattaccattcccgtgctattccaagcgaagaacatgggagatatgggcagcagtatgacggaattattccacccgctttttgtgctgatgctcgttgattttgtcgtacttgcttggctgctcaagcgcagacctttagccccaaaagcgtcatacaagacgatcaaaacatattatgcgatctgctgcagcttcctattgtttcatgtcagctcagctatgatggatcaccctcgatttctgacaagctcttatgatcgtgaagtcattgttagaaacctcgggctgttccaatttcatctgtacgacggtgctgcccaaacggcacgcattggacaaaaggcttttgcagatgaagatacgctttctactgtagcaaactacacaaaggctgattacagcgcaccaaacgaagagtacttcggactagctaaaggcaagaacgttgtgttcatttcacttgaatcgacgcagcaatttgtcatgaatcaaaaggtgaatggacaatatatcactccctttttaaatcaattggctaaaaagagtttttattttgatgaattttatcagcagacagagcaggggaagacgtccgattcagagtttattgtcgctaattctctctatccttctagcagcggcgctgtttttttcacagcgagtgacaatgaatatgacacattatacaagcagttgaaaaaagaaaactatcaatccgtccaatttcatgcgaataataaaacgttttggaatcgtgatgtgatgtatgaatctctaggaattgatcgtttttacgatgtcgattcatatgatgtcaatgaacggaattccactggctggggtttaaaggatatcgacttctttgatcaatccgttgatcatttaaaaaagttgaagcagccttattacagtacgttcattactttgaccaatcattttccatttgaaattgacccgaaggatcagtttattgatgaatatgattcgtccagcactattttaaaccgctatgtgacgaccgtccgctatcaagatgaagcgattaagatgttttttgatcgtatgaaagaagaaggattgtatcacaatacgatgtttgtcctcatgggtgaccattatggcatctctgaggcacatcatgaggcaatggcacagctgctcaatcaagaggaaatcacaccgtttgatgcggtcaaactgcagcgtgttccatttttgatttacattcctggtgtcacggatcaagcaccgcagacgatttctgaaacagctggtcaaatggacgtgaagccgacacttcttcacttactagggattgaaacgaaggattccattcaatttggcaatgatttattttcaaatgaacggacgcctttcgctgtattgagaaacgggaactttattacagatgattatctctatacaaaaaacacctgctatgatcaaaaaacaaaagaacccgtgaagcaggatgaggtatgccagccctatatagaaaaagccaacaaagagctctccttatcagacaaggtgatcaatgggaatttgctgcgtttttatcagcagtaaacaggataaaacgatctcctttgtcgtcatgctaaaagtcgccatttggcggctttttcttttctctttttgctgaaagcctatgaatgctcaaataagtttgcttataataaagggaactacatgatattgaatgataagaggtgtgaacatgaagtatacattcttagccctcatctccatatgtttgctcctgagtggatgccaaacagagatgaagcgatctaattcgaataaagaaacagagcttgtgatttcagcagcggcaagtcttcaggatgcactaaaggaaattgaagcctcctttcacaaacagcatccacatgtgacattaacgaataacttcgggtcatccggcgcattgaagcagcaaatcgctcaaggagcaaaagcggatctctttttctcagcagctgaggagccctttgatgaacttgttcaatccggagacattgatcaagattatatcaaggacgccatacaaaacgagctagtccttattgtgccaaaagatggctcttcttctattaaaaactttcaagacgtccagcacataaaaggaaagattgctcttggcacacctgaatcggttcctgcaggtacatatggcaaagagatcttcacaaaactgaacatatgggaccaagtgaaaaagaatgcagtctacgccaaggatgtgcggcaagttctaagctacgtggaaacaggaaatgttgacgctggtgttgtgtataaaacagacgccctcgtctccaaaaaggtaaagattgcagctgaggcacattcggacatgcactccccggttatatatccagtagggattgtcaaagggacaaaacatctaacagaagccaaggccttttttgaatttcttcaatctgataaagccaaatcaatttttaagaaatacggctttcaagtgtcgtaatgcctatgctgactgaagactttctatcacccatttggctgtccgttcaagtggccatcgttagcggactgttggccactgtctttggcacaacgattggcttttggatggcgcgaactacttttaaagggaaaatgattgtggaaacgctcctgatgatgccgctcgttctcccgccaactgtcgttggctttttattgctcatcgtattcggaaagcatagtgtaatagggggcgcggttgaatggatcttccatcagccggtaatcttcacatggtgggcggcggtcattgcatcgactgtcgtggcatttccgctcatgtatcaatcagcaaaggcgggcttttctacaattgagtcagatattgaaggggctgcaaaagtagatggtgctcattccttccaagtctttgcctatattactgtacctcttgccctgccgtccctcttgtcaggcagcatccttagctttgcaagagcccttggagaattcggagcgactttaatgtttgccggcaacatcccaggaaaaacccaaacactcccaaccgctatctatgtggcgattgattctgggcgtatggaacttgcttgggcatggacgatctgtattgtgatcttatcttttatgatgcttttggctgttcgtagaagcagtacataaaaaaacccctttctcacatgagaaagaggatttttttatttattcaaacccaaccgtcatcgtctctggattcgagccgacgcgctcgttattgtttaatgcatcgattttttccatgtcttcttttgaaagttcgaaatcaaaaatatctgcattttgtttaatgcgttcttcgttgattgatttaggaatcgtcacgacgccgctttgcagatcccagcgtaagatgacttgcgcaacggatttgttgtagcgtgcagcaatgtcctttaatacgtcatgatccaatagctttccttgcataagcggagaccacgcttcaatttgaatgcctttttcttttgcgtattgacgcagttcgacaagtgtcagtttcggatgaaattcaacttggttcacggctggaacaacttcagtatcctttaatagctcttctaaatgctgaatgtagaagttgctgacgccaatggctctcactttcccatccttgtaaagcttctcaagcgcacgccatgtgtctttaaatgtttctgcatttgggccaggccaatgaatcaaatagaggtctaagtaatcaaggcctaatcgatttaagcttgcgtcaaatgcagccagcgctttgtcatagccttgatccgtattccatactttagacgtaatgaacaaatcttctcgtttcacgccagattctttaattgctttgcctacgcctgtctcatttttataaacggcagccgtatcaatactgcggtatccgtttcgtatggctgcttttacggcatctaccacttgattgccgtcctccactttgaatacacctaaaccaaaccaaggcatttccactccgttattcagtgttacggtatcattcaagcttttaaccattttaacaaccacctttttcatagattccatctttttcattatctcacgttgtccattaaaactctattatcagacgtttttcttcgcttcgatggctaacagcaaagcacctgtcatgccggccttgtcttcaagtccaggagagacaatatatgaatcaagcggcggcaggtctacataatcattgagataagcagcaagcttctctcgaattagtggaaacagttgtttttgcttcatgacgcccccgcccataatgatgcgctctgggcttaaaataagcgagtactgcatcagtgcctgcgccaaatagtcggcttcaagtgtccaaactgattcttcctctgtgagctctttagcagatttcccccacctttgctcaatcgctggtccagcggccagtccttctaagcacgtcccatgcgctgggcagactccttcaaacacgtctgattcatgctgcctgacaaggatgtgccccatttctggatgcgaatgaccgtgaagaagctcgttttttacaacagcgccagcaccgatacccgtacctaccgtgatatacatacagctattcagccctttggctgctccttttgttaattcacctaaagcagccgcatttacatctgttgtaaaagatactgggacttctaattgcttctctagctctgggatgaacgggtaatgcttccactctactttcggcgtgttcatgatataaccataggaagggtcgtccttttggacacaaatcggtccaaaggagccgacccctaatgcttcaatatcatgctgcttgaaaaatgggatgagcttttgtaatgttttttctgggtgctctgtaggtatcgtcatttcttcgagaatgtccccgtgctcattgccgattgcacaacaaaactttgtaccgccagcttcaattgctccataatacgccatcattatctccccctgcttgttctctttcctcatcataaaacataggagaggagatgacaacattacgtattggtcagaagaacagcttccatatcattgatatactcccttagatgatgggcaatatcacgattgatttcaccattttcatacaaagtttgaatttcatttcgaatcgtctgtacagcttggaagttaagctcttttttcttccggtcaaatgaacggtctttttgctgaaagaaacttggaccgtgttcacagcgataaatgacttgattgtaaaaaccaattacttgatgacacgtttgtttattttcatcggtcatatgctgtttgatcgagtccacagcagcctctgccgttttcttacggatttgcttgtacgagtcctcgttttctaaaataccgctggaaacgagctgattcggccgccataattggagccattgaagcaagcgtagaaacttcacttttgagaaacgaattttgaaggagtttgaatacagcatttcgagctcatgaaatctttcttgcagctcataggcttcatgtttatcgattttctcttcctcaatgagctgttggagcttcatctgctccgcttttattccatgcagcctgatctttttctcttgtcttctcatcccgaattggtacggctcacgctggatattacgcagcttcattcggtaatcattgatgagcgcaagagacacttctctgttgtcttcattcattccttctcttagcgttttaatcgcacttctcagcagcttccgtttcgcatgctgaatctttgtatccaaatccacagcgatttgtttgtcttttttctcagatagaagaggcagtagcacactagctaaaatgagtgtacataaaatgacgcctgctgcgaggaaaataatcaaatgccgttcaggaaacggtgaaccgtccgcaagtgtaaatgggatggagaaggcaccggctaatgtcacggccccgcgtacaccagagaatgtcatgagcatcgaggcgcgaagcttcggttttttcacgttttgcttttttgttgcgctccatttccctgcccagaaaagccatacccataaaaatctaagaatcatgagacatagcgtgatgattaagatgtaactgatgacctgcatattattaaacgcttcgtcctggaaaataactgtcgatacatcaggaatctgcaatcctagaataacgaaaacaagtccgtttaatataaataaaataatattccatgtgtttgatgaagcaatttgcagtttggctaaatttgcttccattcgatcctgctcaatggcatgtgtcacaccaccagaaacaacggctaaaatgccggatacaccaatttcttcagcggctaaatagataacaaatggtgtaaggatttgcaggatgatgtgcatcgtgacatcgtccattcctaaacggcggagaaaatagcgaaaacgaatgataaaaaaggatagaataaatccagtcaataaaccacctgcggcaattaggacaaagctaaaggatgcctcagcaattgaaaaagcgccagtcactgttgctgcaatggcaaatttaaaagcaacaagtcctgatgcatcgttcatcaatccctcgccttccaaaagtctcatgatgccctttggcatattcacacggctggaaagagcactgactgctaccacatctgtcggtgataaaattgctgcaagtgcaaatgcggctggaagcggaatgcttgggatcatccaatggatggtatatcctgcgacaatgactgtcgcaaagactaaccctagggctaacagaagaatcggcgctcttaatttccacagctcgtcccttggggtacgcttcccgtcattaaataaaagcggcgcaatgaataaaacgaagaataattcaggatttaaagaaatatgtaaacctgaaggaaaagctgccaccagtattcctaagcccacttgaattaacgggactggaataaaggggacaaaacgattgataatattagatgatgcaatgagtgctagtagtacgagcactgctaaaaaaatctccactaatacgtgtccctccttcattcatgtttttgtcaagttttgcttacatgcagtgatgtgttcatttcaagaattcatccgttcaaaagatatatgccttcttagtattccgcaaaaagagaaaccaacacataacaatccatctaggcaaaaaaagactgaatccacatattcagccagctgacaaaattttcatcacatgcattgttctaatgatgaacaaaaagatcctgtttttattttacacgaaaactctcttacctgctgacatccagctcgtatcaaacacaaaaaaagagcgaaatcgctcttttctcgttttaccctttatttaaaaaataagacctagcgggaagccgccatttgaataggtaggaacacactctgcatacgacgaggatgagaaacagcaaatacaaagcaatctctccttgtgctaaaccgagtcctacgagtaagccgccaagtgctgcccagactgcgtaaatctccgcttttagcacaagcggctttcgccctgccaataaatcacgcacaattccgcctccgcttccagtcaaaatggctgccacaatgaccgcactgagcgggagctctctttgcacagcaaataatgcaccttggatcgcaaacgctgctaagccaatcgcatccgagaaattcccccatgtgctccagtgcttgagcaaaagctttggaaaaagaaacacaatcgtaatggatacaagagcaatggtaaacatcttgccctgtgaccataaagcagacaccggaagaccaattaatagattccgaatcgctccaccgccaaatgctgtcacaatccctaaaatgtacacaccaagaatatcgtactcttcctccattgccactatcgcaccactaatggcgaatgcgataataccaatgatacttaagacttcccatgccattttccgcttatctccttacatgatctgatcatctcatactactcccttaatgtatatctgacataagcgaaaagcaatacaaattttctttaaattttatctttttgcaaaaataaaaaatagcctgcttaaaagcaggctatctctcaattttcttttgcatttaagagcagcatactgatgataatcagaataaatgcaataagtgctaacagcggaatggtgataaaaccaaaccagttcaaataatcaacagaacaaggaatgccgctcaggcaagggcgaatcgacgcaaagcctggaatcttttgttccatataatgatagatggaaaaacaagcaccgattacagccaaaggcagtacgtaatacttcactttgacatcaccccggaacgtagcaattccaagtaaaagcacgagcgggtacatgaaaatgcgctgaaaccagcacatatcgcatggaataaactttttaatttcacttaaatacaggctgctcatcgttgcaacgatcgagacaatccaagcactgtacaagtaaataagcttattcttcatgatttcttccctttcagctcttgatcaattaattctttgatttcatcatagtcatagaagttttgaacttgtttattgttaatgaaaatcgttggtgttgaattcactttgtatttgttcacaagctgatcgtctgtgttcagctgcggctgatacgttttctttgataagttatctttgagtttgtccgtatcaatttttgttgtctttttcgccagttcagtcagcttagcaggcgtcacccattctgcttcactatctggctgtgcttgatagacagcttcatggaatgcccagaagttttttggatcttctttccatacttcttcagaagctagtgctgctaacactgcgccatctccatgaacaggaagtggcaagttaataaatgaaaatgatacatcgcctttatctatgtagtctgctttcagttttgggaaaatgtctgtttcgaatgatttacatgacggacatttgtagtccccaaactcgacaatttgcaccgctgcgtttttgtctcctaagacaggctgtcctttaatcgaaggcttactgtcaactgtttgtgcttcttggctgttcttgtttccaatcacaacaaataaaccaatgagaagagctgcgatgatggttaaaatgacagcaaatttaatggatgaagattgattatttttcttactcacatgagcacctaccttatctttttcattccttaaaaaaagaaaaaggataatagctcaggaaaatgccattatccaacttcttctattttaacaagaggggacccattatgaaagatggtattcatgaaattttccttacaattttatttcatgaccctcatcgcatttaaaacagcgagcacggtgacaccgacatctgagaagacggcttcccacatcgtcgcaataccgaatgcaccgagtaataggaaaatgcctttgacaccaagagcaaatgcgatattctgccagacaatccttcttgttcgttttgcgacagcaatagcctctgctacctttgatggctgatccgtcatgatgacgatatcagccgcttcgacagctgcatctgaaccaagtccgcccattgcaattcctatgtccgctcttgctaataccggtgtatcattaatgccgtccccaacaaatagtagcttttcttgaggcgattttttctgatcaatttcttctaatttcgttactttatcctgcggtaataattctgcatgtacttcatcaatgccaatttgcttagcgaccgcagttccaacttgcttagcatcaccagtgagcatgacggtttgaattccagacgcttttagagcagatacggcttcaatggcatcgtcctttaattcatctgcgatcaagattgaaccggcaaactcaccgttaatcgccatgtacacaacggttccgcttcttttttctttttcatacgcaatgccttctcgctccatcaagcgatgatttcccgctaagacgtgagaaccgctgatggtcgccttaattccatgtcccgcgatatcctcgtatgcttcgatctggctttcatcaagcggtgagctgtatgccgctttaattgattctgcaatagggtgagaggaatgggcttctgctagtgctgcaaaagaaagcagctcttcttctgaccacttgtcactggctgtggcaatattggtcactgtaaagtttccttttgtaagcgtgcccgtcttatcaaataccgcgtatttcacagcattcaatgcttctaaatagttacttcctttgacaaggatgcctcgcttagacgctgccccaattcccccgaaaaatcctaatggaatggatacaacaagagcacaaggacaagagatcacgagaaagacaagtgcccggtatacccaatcagacaattgtgctgatggaataagaagcggcggcacaaaggcaagcaataaggcgagcacgacgacagccggtgtataatattttgcaaactttgtgatgaaattttctgtctgtgcttttcggctacttgcattctcaaccaaatctaaaattttcgtcactgccgattcgcttaactctttttgcacttcaatttcaagtatactgttttgattcacgaatcctgcaagaacttcttttcccgcttctacatcccgcggcaccgactcccctgttaatgcggatgtatcaacaagcgagaagccttcagtaacgagcccatccagcggtattttttcaccaggcttcacgacaatacggtcaccggcttttacttcttctggatttacttttttcgtttcatttccgacttttagattcgcgtattctggacgtatattcattaattcactaattgaacgtcttgaacggttcactgccgccccttggaagagctctccaatttggtaaaagagcatcactgccagtgcctctggatattgctgaataacaaaagcgccaactgttgcaatggtcattaaaaagttctcatcaaacacttggccgcgcacgatatttttcagggctttaaaaaccacatcaccgccgactagtaaatatgctgcgaagaacataaggaactttaatacaccatcttcaggtataaagaaagcggctgttccaatgactgcaccgccaattaatttcagcacgatcgtttttaaatttttcgtcccatgatcatgatcgtgatgatgaccatcttctttcggtgatacactcacatgaggttcaatggactgaacagttttttcaattcgcttcgacatcgattcttgcttatctgcatgcgtcacagtcaaggtgcctgtcgcaaagttaacagagcaagcttccactccatccattttgctgacacctgtttctattttacgtgcacagttgccgcaatcaagaccgcttaatacgtattcatccttcatctttttcatgttctcacctttttctatatgataagtaacgttccctggatcgattcaacctattaaaaattaaaaactttatatatgagcatatattcatatattagattatccttattatatgaggatttcttatcttctgtcaatcatttatgaagaaataattggttttttatatcccattctgtcacacggattttcaataaaccaagctcatgtcccccgctctgcgcataacataaaaacgatcgtttgccctccgacagaataagtacagtttttctctttacaaaagaaggacatacgcttagaataaaataaaagtttccctaaggaaacaaattagcattagagaatcatttcatcctttagtcaaaattatttaatgtatgcatatatctttaggaagtgcaatgatgattgaaaggggccgcaagagatgccaaatgctttaacaattgaccgtcttcatgtctcatatcatggacaggatgctttagaaaacatctctctttccatacaggaaggaacgatgacaggaatcataggtccaaatggtgccggtaaatcaactttactcaaggcatgcttggatttaattgaaaaagaccaaggggatattcgcttttttgaccagccctttaaacaagttagaaaacagatcgcctatgtaccccagagaaatgatctagactggacgtttcctattcatgtgctggataccgtcctacttggaacatatccgaagcttggcctgatcaaacgtccgaaaaaagaagaccgggcatatgcgtaccactgtttagaaaaggtcggcatgcaggactttactaaaagacagattggtgagttatccggaggtcagcagcagcgtgtcttccttgcaagagcacttgcgcaaaatgcacagctcttctgtttggatgaaccgtttgttgggattgatatggcaagtgaagagacgatggttcgcattttgaaggaattacgggatgaaggaaaaaccattttagtggtccatcatgatttaagtaaagccgatgattacttcagccatctcgttttgttaaataaaaaactcatcaaagctggacctgtacacgacatccttcgcccagaggtcatgctggaggcatatgaaacgcagctgccattcttaaaatcagcaggaggagacgcgtaatggaatttttaaccggactctttgaatatgcatttttacaaaaagcgttatttacgtccgtgatggtaggcattatttgcggggtcattggctgctttatcattttacggggcatggccttgatgggagacgccatatcgcatgctgtactgccaggtgtcgccatctcttatatgctgggaattaactttttcttcggggccgtcttaactggtgtattaacagcgattggcattggatatgtgagtcaaaacagccgcattaaaaatgactctgcgattggcattgtcttcaccgcttttttctcaatcgggatcattttaatcacatttttgaaaagttccagtgatttatatcatatcttgtttggaaacgttctagctgttcgatcatctgatatgtggattacgcttggcatcggcatttttatcctgctggccgtcatcgttttctacaaggaattgctcattagttcatttgatccggtcatttcttcggtttacggtttaccgaatcgaatgatccattattttctcatgacgttgttgacccttgtgaccgttgcttcactgcaaactgttgggattattcttgtcgttgccatgcttattacgccggcagccactgcgtatctcttaacagaccggctatggatcatgatctatttatctgcttttttcggggcagtttctgccgttgccggtcttgggcttagttttacgtataacttgtcgtctggcgcttctatcgtgctggtcgcgaccattttattcgggagtgcctttatcctttcaccaaagcaaggaattctatggagatcattaaaatctaaacgaaaacgaacgcagctaaaaaaggaagcgtctatgtaaaaggaggacataaatgaagaaggtatttgcaatccgtttaaccgcagtattcattgcccttatgatcatcacaggctgttctataaaccaaaataatttcggcaaagatgacggcacattaaaagtggtcacgacatattccattctttatgacattgtaaaggaagtaggcggagagcacgtctctattcacagcattgttcccattggtacagacccacatgaatttgatccactgccaaaggatgttcagcatacaacggatgcagaccttgttctatataatggtttaaaccttgaaacagggaatggctggtttcaaaagctgctcgaatcgagtggcaaggacggggatgatgcacctgtagccgaaatgagtaaaggcgtcaaagtaaaacatttatcttcaaaaggcctcgaaagccagcaggacccccatgcttggctaaatgttgaaaatgggattctgtatgctaaaaatgccagagatgcacttattcaagcagaccctgagcacaaagaagattatgagaaaaatgcggaagcttatattaaaaagcttcaagcccttcacgatgatgcaaaagacaagttcgaccagctgccaaaagataaaaagcgtcttgtcacaagtgagggagccttcaagtattttgcagatgcctatggactagaggcaggctacatttgggagatcaacacagaaaatgaaggtacacctggacaaatgaagcgcatcattcattttgtcaaagatcatcaagtgcctgcgctctttcttgaaacaagtgtcgatcaacgcagccttgaaagcctatctgaagaaactggggttccgattaaaggaaaagtatttactgactccattggaaagaaaggtgaagatggggacagctactataagatgatgaaatggaatattgacaccatttacaaagggctttcatcataagaaaagacaggcggaatgatgtcgcctgtcttttcctattagctggctatattttgcgggtgttttttcggccagatcacatagctgatgctaatgacgaaatcaatggctaggaccattccccatactctcgctagctgcatcagtgcttccgttcgttctggtgcttggatgaggtaggataacccaaatagtagaccagctccgatgatataagagacaagatgccgggtccagccgactatttcatacactgaccgttccttcccgtactttggtcttcccttcggcttagggcctcctgcaaatcgataagcaaaccggacatctgcccatttcaccatttgatgtccaaaagcaagactcaccccaatataaacagctgcgagcccgtgaatgacactcgccacagccccctgccttaaatccatatacgtcgctgcaagaagaatgagatccaaaatcggtgtacaaatgagaaagaaggcgccccactttttcagtctaaacacataacgaagtgttaaccccaccagaataaacagccaaaagccaatttcacatgccacaatcaataaaccgatcaatattccccacatcctttttaacacgattgtattaaataaaaaataacacaactgtgttaaaaaaacaatagctgtgctaaaatcaatgtatgccaaaaatcgtcgatcaccataaacaaaaacaaaaagtcgctcaagctgccatgagagtgattaaacaagatggattggaaaacgcttctgtccgaaaagtagcggtagaagctggcatttcagcgggctctatgcgtcattatttctccacacagcaggagctatttcttttctctatgacattgattcaggaaagggtcaaagagcggttgacagcacttcagctgaacggttcaacggaagaaaatgttctcgcgttattggagcaggttcttccacttgatgaagaacgaagatttgaaatggaggtgtggcaggcttttacagtcaagtcgatgactgaacctgatttacagccactcaatgcaaagatgtatgacgagcttttccaaatgacccaatattgtttaatgaaattaaaagaagatgggcttttgctcgatcatatcgatcttttagtcgaaactgagcgcctttatgcggtcatcaatgggcttgcattgaatggaatcttgcagcctcatcgtttaccgcctcagctcatacgctccgtgctgcagatgcacctgcaatccatcaccaaaaaagacatgtctccctcatgagggagcatgcctttttttaattttccataaaaatacgttttgcttcgtagtagagcacctgcacaaatttcttcacattgatacgggtatgttcttctctaccgttcgtctcttttgttaattcactcattttctttcgcacgatggtgaaatcaaagaatttagaagcgtaattttcaaaagtcggatgagaaaaatcagttaacccaagtgatgcgatgtgtttcaaggattggttgatcgcacgcctcacccgctgttccgctgccttcgcttctcttgcaatgtctgcagatgtgtaaggctcatttaatttatcctccgtgacaccattgaaaatgacctttaaagaaggaaaggaatcatgatgttcaatatgcagcgctaaatactgatctgtgaagaggatcatatctaataaatctttagaccccttttctcccacaatcccaagctctgccagcaagaactgacctgcctctgcaagagttttcccacgctgcttcgttttggtctgacctcgctgctgaaactgcatgacagatttgagtgagtgctgaatattttcaattgaatgctccaaatgaagccgctcaatcatgaggtggagcacacttaacacctctacacgattgattggctttgtcacataatactcgacaccaagcgtatacgcctggccgattaattcctttgtttctacctgtgacagcattaagtatttcccatgaaactcatccttaatggctcgaatcgtttcaagaccatctctttccggcatcaatagatcaatacataagatatcaatgtgcaaatcatttaagtagcttgctgttaactctgcgccatcctctgcttcccctgcgacaatgccaagctcttcatcttcaatgagctgagccagtgaagaacgcacggcttcatcgtcatccacaataaaaaatctcatctcccaatcccctcttttctactgacttgatccattggtatcgttaacgtgaaaatcgtttgtttatttgggatactcttcatctcaacacttccgccaagcttctccgctgtatccttcacataggaaagcccgataccgcttgatggatttccagcctgatcatattttaaagtaaaaccgggtttaaaaatcacatgatgattacgctctttaatgccaggcccgttgtcactaatttgaaagatcacatggttctctttctgggaaatagagagtgacacctctccatccaccggaatggcttcgacagcattggaaacgatattatttaacaaagatagaatggtatacacatgatagacggggtgctgcccatcttcatcataatgaaagacaatgttttttttaagagattctgcgtaattttcatgaatacgaatcacgagcccagcaatatgcgcaggacttgcataagcctgaaaattttcttcatgtatcagctttgataaggcagaaaaaatccgctggttatcctttttgatctcatgcacctctccagcgatttgcagggctgtttttccgagctttttcaaatccaaagattccgcatcctttgcgtgatgcaaagattgatacaattgataggatgtcgctgtaatgtgttcagcatgtgcaagtgttttatgaaagtatgtagattccgtataaaggttagacaggagcatgagcagatgttccttttcctttttcatctgacgctctctcgcctgctcttcatataaacgaatcattgtataacaagccaacacgaaaaagcttctgaaaatagctaaaacgaaaagttgaaacagcgtacgcatcgttaaaatttcatcgatggtaccacgaagtgcaatcatttcaacaacgctcgcacacagctccatgatgatacctgtcgctccaatcagccaaggctgatcgcggaaacgtctgacctttaataaataaaagagcgtgccgtagacgacataataaagcaggggaggaaaccttaatgaaaccgcctcttccagcggaagatgacctgtcacggctgtatcaagaagcacgcgaaatacaaaaacagaaacccctgcaatgataccgcttgcccatgccggaaattttttcatttgaagcaggataaagaaaaagacaacggttccaaagctgacccgaaagctgtcctcaaatggataaaatttaaactctccgccaatcggtgtcagtacaatgagcatgacaatcaaataaggctctgtattcaaccatttttttagtagattcaagcgcagtcacatccctaataattgacgatagtatactatgtgagcttcagaaaaacaaacagtccatgaaaaaacgcacaccgaacatttgtcggtgtgcgcttctcatgatgccgcttaatcttctaaacgatccttttctaaaagtgatgcgccagcaatacctggtttcgtcatttcaaaaggatttaagataatatcaagctcttcctctgataacacatcattttgcagacaaagctcacgtacagatacgcctgtaagaatcgcttctcttgcaattcgtgcagcagcttcataaccaatatgcggattgaccgccgtcatgacaccagcactcttttctacatattcttttaatctagattcatctgcttttaggtcacgcaagcagttgtctacgaaggactcaaatacattcttcataatgctgagagattgaagcaggttgaacacaagcaccggctccatcacgttcagctcaagctgcccagcctctgatgcaagacagatcgtgtggtcatttccgatgacttggaatgccacttggttcatgacctcaggcatcactgggttgactttccctggcatgatagatgaacctggctgtctcggcggcaaatgaagctcaccaaagcctgctcttggacctgatgccattaagcgaatatcgttcgccattttggacatattcatcatacatactttcagtgcagctgatacttctgtataagcatccgtattttgcgtagcatcgactaagtcttctgctccaactaaaggtaatccgctaatatcagatagatagccaaccacctggcgaatatatttaggatcagcattcaagccagttccgactgctgttgctcccatattgacttcatataaatgctgtctagactgcttgatacgtttaatatcacgagcaagaacctttgcataagcattaaactcttgaccaagtctgattggaacagcgtcctgaagatgcgtacgtcccattttgatgacatgatcaaattcttgtgctttttctgtcatgacttgatgcatgttttccatcgtataaagtagtttttcaatcatattcaatgtagaaatatgaatcgctgttgggaaaacgtcgtttgttgactgcgacatgttcacatgcgtgtttggacttagctcagtataagcgcctttttcctttcctagtagttcaagcgctctgtttgcaatgacttcattggcattcatattcattgaagtaccagccccgccttgaattggatcgacaataaattgattgttccattttccttcaataacctcatctgcggcttgaacaattttttctccaagaccagaatatagtcgctttgtatccatatttgcaagtgcggctgcctttttaacaatccctaatgctttgatgagttcctcatgaacatggtagccagtaattggaaagttctctactgcacgtaatgtttgaattccataatacgcttgagtgtctacttccttttcacctagaaagtctcgttcgattcgaacttgcttgtcctgtagcttcgtcatttgaaaagatctccttttacgctgcttttgtttgttgttttaattcctcaatatacttcttcgatttctcttgatcaaaaactttttcccacttagacatgacaatggctgcaagtgaattaccaaatacgttaacagttgtacgaaccatgtcaagaatacggtcgatcccaacgatgaaggcaagtccttcaagcggcagtcccattgcaccaagtgttgtgataacaacaacgattgatgcacctggtacaccagccattccttttgatgtcagcatcaagattaatagtaacgtaatttgctcatagatggaaagtggcatgccgtacatttgtgcaacaaatatggcggcaatggattgatagatggcacttccatctaagttaaaggtgtagcctgttgggataacgaacgacgtgatcgctttcgggcagccgaacttctccattttatccattagtctaggcagtacagcttctgaacttgctgttgagaatgcaagaatgatttcttcttttagcactctaaatagtgtaaagacgcttgttccagctaattttgcgataatgccaagtacgacaatcacgaagaatgccattgtgccgtaaacgacaagtaccagtttacctagcgggagaagcgctccgaccccgaatttgatcaccgtcacactgatgagcgcgaatacaccaaatggtgcaaacttcatcactttattggtcacccagaacatggcttcgagtatcccctcaaagaaccctaacactggtttccctttgtctcctactgcggcaattcctaatccgaataagacggtaaagaagatcgttggtaatagatcaccttctgcaatggattggaaaacgtttgttggcactagatgcacaatcgtttcagagaaacttgctttttcggaagaagctttcgatgtctcttcatatttagagatatcgcccttttccatgttgctcatgtcaattcctgtaccaggatggaaaacgtttgctgcaagcagtcctactgctaatgcaatcgttgtcacaatttcgaagtaaagaatcgttttcccaccgagtcttccgatggttttcatatcccctactccagccactgctacaatcaacgcagcaataacaattggcagaacgatcattttaattaaatggatgaatatatcgccaatcggcgttaacacattaataacggtttcattttgataaaacagcgctcccacgataacacccagaacaagtgcaatgagtatttgagaagctaaccctaactttttcatacgtgaaccccctttttttgataacgctttctttgttgcttaatcgcatcttaacgatgaacctacaaaaaacgacaaaaaggaacaaaaagaagtgaattttttatgaaaaatcttttaaaaggtgggtttttccacaaaattgttaaaaaaagacttcgcttttgggcgaagtcctaatgattttgcatttgttcacttggtgtatcttgttgtggataaaattgatcgtacatcgcatatccaatgaggacaagagcaacatagaacaatgcactaatcgtccaaatccatttgacattcagtttcattgtgccactccctctctcaccggtttcaatcgctgcaatctgagcgcattcaatacaaccgacacggagctaaaggccattgctgctcctgcaagccatggcgcaagaagtcctaaagcagctatcggtatcccaatacaattataagcaagcgcccaaaatagattttgcttgatgtttctcatcgttttttgactaaatacaagcgcatcagcaatggcatggaggtctcctgtcatgagtgtgatatctgctgcttccatggcgacatctgtcccagttccaactgccatcccaatattcgctgtcgcaagagctggggcatcattaataccatctccgaccatggcgactttctttccttgttcctgaagcgccgcaatgtgagcagccttttcctctggcaggacttcagcaatgacatgatcaatgcccgcctgtttcgcaatcgcctctgctgtcatcttgttatcacctgtcatcatcacgacatgaattccttgctctttcagacgcttgatcgcttgagatgaggatgatttgatcgtatcggctaccgcgacaatgcccgcaacttcaccgtcaatcgcgacaagcatagccgttttcccctgctgctccagtgttgaaacggatgcttcgacttgatgatatgggatatgatgtttctgtaataacttacgcgtcccaatcaaaagcttgtgtcctgctgcctttgcttcaattccatgacctgggtctgcttggaaggattcaatctcgaccgtttctagaccttgttccttcattccatctgtgatcgctctggcaagcgggtgttccgactgctgttctgctgatcctgctagctgtagcagcgcgtcttctgtccaattggcatatgccagcacatctgtcagactcggctccccttttgtcacagttcctgttttatctaacaccaccgtgtcgagtgattgagtcacctctaaatgctccccgcctttaaacaggatgcctgattcagctgcacggccgctcccagccataattgaggttggtgtagcaaggccaagcgcacacggacatgcgatgacgatgaccgctataaaggtttcaagtgctgctgtcacatttcctggatcaacaaagaaaaaccagatcaggaaggtgagcactgcaattcctacaacaatgggaacgaatatccctgaaatttgatctgccatcctttgaatcggtgcttttgagccctgtgcttgttctacgactttaataatctgtgaaagggcggtctctttcccaacctttgtcgctttcactttcacaaacccatttttattgatggttgccccaatgaccgcatcaccagccgttttatcaacaggcagactttcgcccgtaatcatggactcatcaattgcggttgttccctccacaatttctccatctaccggcactttctctcccggtttgacaaacacaagatcattcactttcacttcagaaataggaacagtcatctcttccccatctcgctcgatgaccgcttctttcgcttgtagacccattagcttttgaatcgcttctgatgatctccctttcgctcttgcttccattaattttccgagaacgatcaacgtaatgagtacagcacttgtttcgtaatagagggctgcctcatgtgtgccttgaaccgctgactgaatgctttcatataaactatagaaaaacgcagctgatgtcccaagtgcgacaagaacatccatgttggcacttttattacgtaacgctttatacgcacctacatagaagggccagccgacaatgaactgaacgggcgctgctaacgccagctgaacccaaggattcatgaacgcttcaggaagccaaataaaagacgtgaaagaaaaatgactgaccattgcccaaagaagcggcagtgacagaatcattgaaaataaaaagcgtgccgtctgtttctctattgctgcttggcgatgatctttctttccttcctctgcttcatctacagctggttcaattaaagaatacccaatggactgaaccgcatcctttatatcacttgtagacgtttggtcagggtgatacgtgacctgaagggtctccagcgcaaagttcacagatccatgatcaacaccatccatccgattaatttttttctcgattcggttggcacacgctgcacacgtcattccctctatatcaaattctgcttgctccatcaccacatcgtagccgagggattgaattttttgctttagctcctctggtgtgagttgttctgcttcatacacaatatgagatgtttccagcgccaaattcacattggcatcctccacaccttccagccttttcaatcccttttcgatgcgtcctgcacaggcagcacaggtcatccccgtaatttgaaagtcgatttccttcttcattaacctcacctctccatatacaccatgggggtattatattttgaaaaaaatacgtgctgttatgcagcacgtatgttcatttatacgacatcatatccctgttcttcaattacatcagagatacggtgcaacgtgacttgttctgggtgaaaagaaacttccacctctcctttgtctaaatggactttcacagattcaacacctgctagttctcctacatttccttcgactgcttttacgcaatgtccgcaagacatgccctgcacttgaagtgttgcttgttccatttctcatcgcctccatcaatcattttctacacttactataccccagtagggtatcattgtaaacatataaatgctacgattttgtcagtttcgtaaaaaccgtcattaactcttcaatggcttcatcaccattgccgctcttaatcgcatccgctacgcagtgatgtgtatgcttttccatcaaatgaaggctgacctttttcaaagccgcattgactgcggagatttgattgacaacatctatacagtaacgatcgttttcaatcatttgctgaattccgcgcacttgtccttccactcgtttcagccgattaatcaattgatctttttccttctcggctctaggcgaagccatatgtctttcttcatgttctgtcatgtgatcacctttttccattatgacttgtctttccttaaattaaagcatatctccaccggaaaaggcaaagatatgctgaattcactttatagtgtttgctttagtttgttaattgttcaatgtcctgcaatagattcacggactgctgaagctgcttgatcaacccttgctggtcctcaagcatggcggcaacgtcgatgttatctgccttcaattgctgtaaatacgtttgaatttcctctgacagcaccttatttttttcaatgatctgtgcatgcaggtcttctgctatttggggtgctttgacttcattaaatgcctgaatgtctgccttcaatgattctaactgcttgattaattctgcttttttggcagcgtttttcacagcttcttcagcaagttttggaaagtcctctgtaaattgctgaatgtctgtgacatagtcattggcctcagtgacatatgtcgttgtatcgttgacttgatcaagtaagctggagcacccgcttaatacaagtgttccggaaaataggaaagctatcgcatattttttcaagatcgatcatcctttcatctgtgggattaaacgcatcatttgttctgcttccctatcacacagacttaaaaagaccttaaaaatagccagacctttgcctcatgtgtgataggcaaaggtctggctaacattgttcatgccggaatggccgagaaacaacggatgtttctgtaatgacgaccaaaccgtaaaagctactccccttttaggaaaccgttcaaatgttatgtttatcatatcgaatgtcaggacaaccgtcaatgagaagctagcggcatgtcaattcttctcttcataaagcatatagtctgctccagttgacgcataaatccggttgcgtccttggcgttttgacatatacaaggcttggtccgcttcaaatagaagagtttctaatacatttggatcataagctgtgtgagcaattccaaagctcgctgtcactcgcactttttcctcatcattctcaaagaaactcatctcaaacgaatgtctaattcgctccgcaatatgacatgcctcttcaaaagaatgatgcggcagacaaatagcaaactcttctccgccatatcgtccgaataaatcgtccatttgtaaatgctgctgacaaatggtgacaacatgacgcagtgcctcgtcaccaatatgatgtccgtgcgtgtcattaatttgtttaaagaaatcaatatcaaacagcataacagccgtatcctgcgcatcctcttctaggatcatctgcgttcgttcaatgaatgaagaccgattgaagatattcgtcaattcatcaatatatgcacggcgctccagctcttcctgcaataaacgctgctctgttacatcactgatcacaatttgcctgccctcaatctctcctcttctattaaatagggacgatgcggtcaagtgataatagctggaatgatctttttcctttttcaacattagatcatattgcgaatgatcctgcggagaacgcagccattgaatgaagtcagtatctttgatgatccctgagaatatatcgtctattttaaaaccaatcccctttttattagaaagggctggaatgatcgatgcagcagcggggttgtaatcgatgagtgttcggtaccgatctaaaatgagaaccccttcagacatatgctcaaacacacgctccatcgcaatgggagagagcttaaagagctggaacgacataatcgcccataagtagagcgcattggttaaaaacatcaccacagggaccgggtcaatatgaagaggtgtcacacctaataaatagataaaagatgtcgtaattggcagtaacatgcccactagcaaaataaggatctgctttaaatattccttttttgtgacacgcaaaaaccaaaccagcataaaaatagcgagcatcgaacagccaaatgtatagacgccatgaatgatataccaatagccaatcgtaaagtcagccaataaaaatccgtctactggattcatcgtaatgcttcgataaaagagtgaatgaaaagagttggtgaacaccataatggtggtgagagttggaatcagtaagatgagaagcacgcggcgctttgtgaaatattgatggaatcccgtaaattgcagcacaatcatcagactgaatggcgcgatgaacggaagacctatgtattgaaaacaaacccagaacataatctccctaggtgtacttgccaataattcaaacgtgtgcccaaagatataaatcgcagttgctccagacatgtacataaacaattgacagccaatataccggtagcggttcgcatgagcaatgattgataatatcacggacagaatgccagaaacactcatgatcacaataaaatgtaaaacaatcgaatccatgtaaacgccccaatttcagttatttagaactagtctaatcttactatatatgaggaagtcacaaatgggaagatgtgattttgaattggttgggggttttttgtaaagtttcggtcgacttttgtccaagagaccttatatttccgctactttttgcttaatttgagggagagatatgttgcgttcggagaaatatctgtacaatgtggggattgggaaatcaatgaagaggaggcttgcaaggtatatgacttttttgattataatggcggggctgtttatgctgattcttttggagaagccttttgagaagagagcatctggattgatatttttggtgagttatttactgctgatcgcagtttatgtggttcaaacaacttttgtgaaaattgtatcgaatggtttgttgatgatgatggcagtgattgtggtttgtcctttattttttcgattggtgcagtcttctttgaggaaacattcttgaaaactataaaaaattgaacctagattaatattttataaattaaaaagtaaagccaaatatacaacaaaggtcaaagctaattgtacctggtcaatagagttatattcttgggaataaccaaaataagcaagcatggagcttgcttattttcatcatcgcttattagtaaaaaacttatcaataatgttaatagcaataagacaaataggaaatgcgatgataatgtacagaaaatttttaggtacaaacatattgtaataatagaaaaatacgctgataaacagaattataacagcatacttcattatattcttcacaaaattcctcctaataaatatccacccaaccattattagggcctttatcccttttatctaattgtttagcaatttgggttccaatatccaaataatttagagcaattgcgacagcaaaaccaattacagcattgaaaactgcacctgcaaacctaacagatacaccaacctttatacctgatgattttttctttttagcagcttcaacttctttaaccccaaaggaagaagcaaaaacctctttagcaaatgctaagttctcattgatactccgaataataatttaggttataatactacggaataaaaaaaagacgcttaaaatagcgtcttttttattcttaaagtttttaataaaatccttttgtgttaaccaatcgtttagaacaccatgttgccaaaatgttgccagtcccgtaccaagggctttcaaacccttgatacgactgcattctaaaagttttgatggagacggtgggagtcgaacccacgtccagagacatcgattacttaagcgtctacgagcgtagtcaacatatttggtgttcactcatcctcatgcctgctgacgggcgcttggagagctagtctgatggatctcttcttacgtcctcagacgaaaacgtaagcgtagcctacttcattgggctcctcacagacacataggcgatgtcaggaagagctcgctgcacttattaggcagctagtgctaagttttggttaaaacttttagttttgccagttacatttagtgcgtgttaacgagatcgcctctcggctcgcagctcaagctcgaaccgcccctgtcgaatccgtaacgtccccttgtaaaagggatatacgggatggaagttcagcttaactgcttccgtatataactattataacaatctcatcgcttgaaacaactggtggtttctgtaagaaaagcgatgattgtttactgcataacatattgtagcataatgcttccgctctcagcaagccatctgcatcaggctagaattgcttttgacgatcacggaaggcacggtcgatttcgcgttttgcatcttttttctttagatcttcacgtttatcgtatttctttttccctttaccaattccgatcaacactttggcgaagccattttttaaatagagtttcagcggtacgagtgagtagccttcttcctttgtcacaccaatcaatttgctgatttgcttgcgatgaagcagcagctttctcgttctcagcggatcatggttataacggttcccctgctcgtatgggctcacgtgcatgttatgaagaaacacttctccccgctcgattttggcaaaggaatcttttaaattcacttttcctgcacgaatcgatttgatttcagttccttgtaacacaaggccggcttcatatgtttcttctataaaatagtcatgatttgcttttttgttttgggaaacaaactttccctctccctttggcattggcgtacaccctccttttgacacaaacacggtccaaatcgtacggattattttatcaaacaatccagctttcgacaatgatgacgctatgtggtcaaaaagcaaatagagcgtgatgccctatttgctttttgtcacgttactttttctttttacgcttttgttttggcgcgttatcaaatacacgttttttctttttcttctttttacggcctgtgaaccagtcacttccgcctttatcctctttggctttatcaccagaggcattttgacctccgcgcccttttttcgctggtgaatctgttcgttttttaaacttaaaatcttttggcgattttcggcgggtgcctttcatgccgacgatttcaaaatcaatcgagtgctcatctttattgacattcaccactttgactgtgatttcatcaccgatacggtagacatttcctgtgcgttcaccgatcatggcaaagtgctgctcatcaaagcgatagtagtcgtctgtcatatagctgacatggacaaggccttcaattgtattcggcagttcaacgaatagtccgaagttcgtcacggaactaatcatgccatcaaattcttcaccgattttatcaagcataaattctgccttcttgagatcatctgtttcacgttctgcatcaactgagcggcgctccattgtagacgcatgatctgcaatttcaggaagcagctggccccacttttctagggttgcttcgtctgtctttttctgaatcaaataggttctaatcagtctatgcacgattaaatccggataacggcggatcggtgatgtgaaatgtgtatagaattccgttgataaaccaaaatggccgatgctttccggatcatatttcgcctgtttcatcgaacgaagcatcacggtttgtatcacaacttcttctggttgatccctcacagcatcaagtacactttgaagtgcacgtggatggatgtttgtcgacgttcctttcacaatgtaaccaaacgttgtcacgaactctaaaaagcgctgaagcttttcaggatttggttcttcgtgaattcgatagatgaaaggtacattcaaccagtggaaatgctctgcaactgtttcgttagcaacaagcatgaattcttcaattaatttctctgcgactgaacgctcgcgaacgacaacgtcttttgctgcgccttcatcatctacaagcacttttgcttccttgaagtcaaagtctactgccccgcgctccatccgtttttcacgaaggatctctgcaagcttctccatctcttgaaacattgggacaagcggctcgtatttgtctataagctcttcgtcttgatcgactaaaatcttattcacatcagtataggtcattctttccgtcgttttgatcacactttggaaaatctcgtgtttgacaaccttcccatttcgatcaatgaccatttcacaagacagtgtgagacgatcgaccttcggattcaatgagcaaataccgtttgacaggcggtgcgggatcatcggaatgacacggtctacgagatacacactcgttccacgctcataagcttcctgatcaatcggtgagttctcagtgacataatgagagacatctgcaatatgcacccctagcttatatttgccatcatccagcttttgcaccgtaacggcatcatctaagtccttcgcatctgctccgtcaatggtgacaatcgtttcgttgcgcagatctcgcctgccttcgaggtctttttcatcaatcgtttcaggtgtgtctactgcctgctggagcgcttcttctgggaactcccctggcaggccgtgtttatgaatgattgatagtatatcaatgccagggtcatttttatgaccgaggatttcagtcacttcgccctctgcactcattcttccttctgggtagctagtcagcgtcacgaccactttatgcccttcgaccgctccatttttagcggatttcggaatgaagatatcggttgtgatttttttatcatcaggaatgacaaagccaaagcttttcgtttctgtgtaggtaccgacaaccgtctgagtattacgctccagaattcggatgaccgttccttctttttttgtgccgtttgatttgtggctgacacgaaccatgaccgtatcaccattcatcgctgtgcctagctcattaggcggaatgaaaatatcatcctgtccaaactcttctggtgtcacaaatgcaaagccttttgcatgagcagacagctttccttttaccaagttcattttttctggtacaccgtagcgatcgctgcgcgtgcgaacgatgagtccttgatcttccagaatcacaagcgctttgacgagctctttataatcatctggattggtaatctccatcatcacttccagctcttgaacggttaacggtttatacgcttcatctttcataaaagcgagtagttcattcataaattcttctttttgcacactctaaccccctatatatttaaattgaccaatcaagtgattctaggaatgtatatacatcctgatgaaccttctcgcgctctttatcaagcgtgatcgcatgacctgattcttcataccatgtcaattgcttttgatctgtctctacttcgttgtaaatgatattcgcactgtctgtattaatcatatgatcgtgacgtgcctgaacaacaaaagtaggtgaataaatcatgtcgacattgtttctaacatctgcaatgagttcttgcaggctcttaagtgtatccattggcgttttcttgaactcttccatttcctgttcaatttggtcctctgtcttaccctcgaatttcttatagttacgggcatattctagtacaccctggtacatgacttcttcactttttatgtacataggtgcacacataggtacaattccctttacaggtacagtgtaacctaatttcaatgaaaaaactcctccgagggataggccgcaaaccgcgatttcatcatagccttcatcctttaagaattgatagccttcttgtacatccttccaccagtcatccggtccaaaatggacaagctcttctggcggcacaccgtgtcctttatattgtggtgcatgacacgaataccctctttcgttcaaataacggcccagcattcgaacatcggctgtattcccagtaaaaccgtgaagaagaagcactgccttttctccacctttaaacgtaaatggttttggtgtaacaactttcatgatgtgacttcctttccttctgatatggtttatattttccacttgtatgtatgaaacaaacactaaagagtgctgataataaaaaaaggtctgaaaaaagatcagaccttctgttactcgcgctttacacgcctaaatatgccaatgcaagtgttaaaatgaagaaaagcactgacaaaataaccgttaaacggtgaagtatcaagtcaagacctctcgctttttgcttaccgaaaagctgctcggctccacctgaaatagcgcctgacagtccagcacttttactagattgtaacaatacaacgatgataagtgcgatactgacaattacgagtaatgtaataacaaatgcgtgcatgaaaacacctccagacaaactggtacacataactttattttacatgaaaacaaggtgcatgtcacgaaacatcaaaataaagattccctctatattctcgactttattcgttattttgattcaatttcattccaaagagtagtatgcagcatttttcatatgcaattttcggttaaaaacacgtttttaacgggttgcttcttctttcaatagctgttttaattctactaacaaacgttcagctccttcaggactcagcatcactttcccatttccatagcttttgttatacttcgtcacttgtccagttaacaggcagctcttatcagcatcatattttttcagcatgatggtttgatcttcaatgaaaatttctaacagctgctcttctttaatattgagcaccttgcgcatttctgaaggcagaacaattctgcctagtgaatcaatatgtctgaccatcccagttcttttcaacgacattgcctccttgatcatttcattcattgacttttgtcaacattttcatagtaaaatagatcttcaaattttttatcaaagtaatgaatcattttgccaatgacaagctggcctggtttccggtgaccatttaataccctgctaagtgtagcaggagaaatgccaatttcatcagcgagctgatttaaagacatatcgttttcgatcatatactgcatgacaaaagtccgcctgatctgaatcttttcgaccatcattacaacctcctatggaatcaatatgtacaacgtgtaggtgctcatatgaaccagatctattaacttaagtcaacacttttacccctctgctatttcctttggtcaatgatcatactaaaataagtcatatactgaaatgtgaggttcgatgtcatgaatcactttggtgaacaattacgcattttaagagaaaatagaaaaatgtctgtcaatcaactcgccatgtattcaggtgtaagcgctgctggtatttctcgtattgaaaatggaaagcgtggtgtgccgaagcctttaaccataaaaaaattagcacacgctttgaaggtgccttatgaggatttaatgctgcttgccggtcatattgaacaggaacaagttcatgaaatgaaaccaaaatatgaatccgtgttgaaaatctatcaaacggcgcttcaaaaggatgtagaacatcttcccatttttgacggtgacctatgggaaaggctatccgcacaagacatcagccagctgaatgaatactttctcacgctcatcaaccaaaaaaagacgaacaaatagcggggcataaccttaagatacattcactattaactaatgtcaatattttcatggtatacttgttgccaatagtcaacaaatcaagtaaaatagatatatctaatctataaccatgtgaggttttgccttgatgaaatttggtgcatatttaagagcattacgtgaggaaaagaagctgtcagtaaaccaattagcgatgtattcagaggtcagtgctgctggtatttctcgtattgaaaatgggaaacgcggcattccgaagcctcctacgataaaaaaactagccggtgcattaaaggttccctatgaggaaatgatgcaggctgcgggctatattgaggaagtctcttctgtccatcagttgaaggaagaggaaatggcactatccaaaataaaggaagccgcagcgcaatacgaacttggcgatctcgaactatttgatggagacatttggtcaactctttcgaaaaaagaaatagaagacctcaaccgctatctgttatttataataaacagccgttcgtcatagaatgttttgatcattgacaagctttttgagctgatttatgacaaatttacggtataatgggttcagattggagtgaagaaagatgaatcaatctgatatgtgcccgcggtttgaaaaagcagttgagttattgagtaaacgctgggttgcactgattgtttttcagcttctctcaggtccgcagcgttttagtgaaattgaggccgctctgacaaatttaagcggaagagtattatctgagagattaaaagagctagaagcagcaggcattgtaaaacgggaggtttttgctgaaacacccgtgcgtattgagtattctttaactgatatggggcgttcccttgcacccgtttttgaggaaatttcgaagtggtctactgaatggatcacgcttgaatcataaaatccccgcatgtgaactgcctgatcatcataaaaaaacctcccttacagacgtaagggaggttttgtcatttcaaccacttaagcagatgtcatgtttttttcagctaatgcttttctttcttttttcttgttcgttgggcttaaatagcgttcgagccagcccatgactaggtcagcgataatggccatgagtgcagttggaatagcacctgctaaaatgatggctgttccgtttgtggcgtttgatcctctgatgatgatatcacctagacctcctgcaccaacaaatgtcccaatcgctgtaatgccgatggcgatgaccagtgccgttcttaaaccagccataatgaccgataaagcaagcggtaattcaaccattctcagcacttgccatttcgtcatgcccatcgctttacccgattctaaataagcatgttcaatgctgacaatccctgtatacgtgttgcggatgatcggcagaagcgaatacagaaagagtgataagatgactgtattggcgccaagtcctaacacaagcattaacacggaaagcatcgccaacgccggtatggtttgaatgacgttggtaatggcgaatatccaattgcttagcttacggtaatgcgccacaaagatgcctactggaattccgactattgccgcaaacagcaccccatacgctgacatgagaaaatgccgataaaattcttctaacacatatgaaccgttctgctgataatacgtccataattgctgcagtgtgtccatcagacgtgacacctccccatcttactcaaagtaattgttctttttcaggaaattcttcgcaacggtggctggttcttgaagctccccgtcgacttgatagttcagctcttgcatttgctctgtatcgatttttccgatcagtctgttgatcaccttatctagccctggattctcttttaagactttttccgggacaacaggcgatgcgtcatatggcgggaaaaaccgcttatcatcttttaaaattttgaggtcataggctttgattcgtccatctgttgaataggcaagcacaatatccattttttcattttttaatgcatcgtagactaaaccaatctgcattggatacgtgcttccaaattcaattccgtatgttttcacgaatccttcataaccgtcgcctttctttttaagccaaatattatcgacaccgaaccggtaattcttcgcattctttttcaagtcagagaccgtttctaacttgttttccttcgccatcttttgcgtcacggcaaaggcatacgtattatcaaagccataggaatcaaaccatttgtaatcatagcgtttcttaaattctttttgaacgatttccattgcacgctccggatctttttccgcatccattccaagcgtactcgtcaaatctgtccctgtatatcttgtcgcagaaatgtcgatatctccattttccattgctttctgctgtacggtattagagcctaggtttttcacaatggttgtctttttatctgtgtaatgttcgatgatctcgctcaccatataggccattatttctgattcggtaaagttttgtgctcccacccgtagcgtattgcctgaggagccggctagtccaggaagtgaacagccgcttatcaataacaagcaaccggcaagcagtgcactgatccattttgtttttcgattcttcacataagccaactccttatgaaacttccttcaatccttttaaggcttctggtgttacttttttctccagcttcatcaatgtaaagtcgatgatgactgctaaaatagtgactgggatggcacctgcaataatgtattccggctggtatagctgaagtccaatcaaaatgtagtcaccaagaccgcctccaccaataaaagcagcaagtgttgtccagccaattaaataaatcgttgacgtacggacacctgccataatgatcggtacagcaagcggaagttccacaagtcgaatttgctcccatgtcgtcatgccgatccctttaccggattcaagaaggtttttgttcaccccttggacgccagcatacgtatttctcaaaataggcaataccgaatagaaaaagagagcaacgattgcaggtattttcccaactcccaaaataggaataaaaaatgcaagaatcgctaaactagggagtgtttgaaagatatttacgacaccgatgacaaagcctgcgcctcgtttcattcgcgtgagaacgacgcctaaaggaacggcaacgataattcctagcacgacagcaattaaggaaatatataaatgctcccacatttttgtgaggagttccccaccatttttctctagaaaatcgatgatttgatccatgtgtccacctcccttagttcatttcaatggcagacgctggcgtatcgtctccccaaatggagtcgtacacaacatctacaagacttgcccgtgtcacaatgccttttaaatgccctttggcatcgacaactggtacatatttaataccgcgtattaagattttccgaacggtgtctctgagaagtgcgccttcttgtacagtatagaactctgtatttaagatctcaccaacgaaagccgcttttctgcggttcgcatcaatagtttcaatatcgatatagccttttaacacatcatgttcatctactacaagcaaggaatcgacccgcttttctctcatgatgtagatggcatcagtcaacgtttgttcgactgtaatggtaactggtgacgtgttcatcatttgttctacacgttccatattcggatttgactgaagcaggcgttcttttccgatgaattcttctacgaactcgttggctgggttacgtaaaatatcttctggtgtgcctacttgaacaatctctccatcttttaaaatcacaattcggtcagccagtttaattgcttcatccatgtcatgtgtgacgaatacgatggttttatttaacgttttttgcagcttcttaaattcttcctgcagtgtatctcgtgtaattggatcaagtgcaccaaatggttcgtccatgaggatcagagggggttctgctgctagtgcgcgaagaactccgatacgctgctgctgtcctccactaagttcatgaggatagcgctctaaaaattccgggcccatgtcgacgagcttcagcagttcacgtgctcgctctttccgtttttcttccggccattttaacagcttcggcacaagtgagatgttttgcgcgatggtcatatgggggaacagtccaatttgctgaatcacataaccgatttctcttcttaattgaactggatcttttttcatgatattttctccctcgataaaaatgtttcctgaggaaggttcgatgagtcggttgatcatcttcatggttgtggtcttaccacagccactcggtccaataaaacaaataaattctccttttgctatgtctaaatcaatatttttgacagctttttttccgcctttatacgtcttagatacattctctagtttcagcaaatgagacacctccaattagttggatctatatattcagaaaatttacaccttattaattatagtgcaaactttataaaataaaaagtttatgatgtgtttgtattgcataacatttatataaaattttcagttatcgctgtaatatctagagatctctcctttttcctccaaattactagcaattactcaatatttattgttttcatcaacaaacaggtatatgatatattgtgttacaaattgtcagtcgtgaagggatgaagcggggagtggacaagcaagcgctaggcgccattcaaaaagcacaggatcattatattgaaaaagctgcagagaacatgaatgcctttggtctttcttctacagtgggtagagtgcttggtatcattcacatgaaccgtaaaccaatgacgctggaagagctatcagaggcgaccggcatgagcaaaacgaggatgagtcaagtcgttcgagaaatgctcgatttaaatattgcggaaaaggtttatgaaaaaggaatacgtaaagatctttatgacgttgagcaagatcaataccaaacgtttatttcattgtttgcagccaattggacacgtgttgtcagtaaaaaccgtaaagcacataagaaaacgtgcaaggaattgcaagagctgcttgaacaggaagatttaccagaagaaacagaggataaaatcaatctgcttctttcagaaatcaaggaaagtcttgattactatgattggattagccgcttaattgagttctttgaaagtgaagaagtatttaagcatgtgccgaaaccttaaaaaaagctgttttattttacatctttgtagaaaaaaacagcttttttatatacacttatgacataaacatcggaaacatcccttttaagcctgcgccgatcatttcaactgccactacagccagaattaatcccatcaaacgcgtcacaacattcatctctgttttccccatttttcgcataataaaacttgaataatgaaacgcataatacgtcatagcaagaacgatgacaatgccaattagaatcgaaaacatgtggagcatcccttgacttccaggggttaaactcatgactgtagcgattgtaccgggaccagcgatgatcggaatggcgagcggcgtaacggagatatctgccttctctttgctttctgccttctcctccgaatgaggattttggacgtgtgattcttttgcattcagcaaattgtaagcgataccaaaaataaaaataccgccagcgatgcggagtgcatgaatatcgatcccaaacaatttgaaaataagcctgcctgccaataaaaaggcgatcaaaataataaaagagaccacgacggcttttttggctgtctgggagcgctctttctctgtatagccctctgttaaggtgatgaaaagaggtacgtttcctatggggtttgatacagcaaataatgagacgaccacatgaatcataaaggaaatcaacaaacaccctccttttttcatagtgtctgccattctgatgtgaatattcccttatgatgttaaaacctgtatatatttaaccgatgataatagaggtttaaagaaaggggttcacacatgaagaaaacaataacgatcattcttctttctgtagcagttatagcctcaggtggctggattgtttggcagcagcagaccatcgaagaagcagagaaaactcatcagcaagaaagcaaaacgagcgatctgaagctctcgcagttaacatcagatcaaacagatatgaagcataaaaatgatgaacaaaaaaagcaaatagccaccgtcacaaaaaagctcaaaaaagaaaagaaagcctatgaaaaagaggtcaaacagcgtaaagcgcttgaggtaaaagtcgaccagcttcaaaaagagctgacggcagcaaaagctactgctcaagcaaataagcagaccactcagtctacaaggaaaccaactgtcaaaaaagacccgaatgtcactcatcatcctccctcacagtgggtacaggaccaatacgattggggcgtgaaacaagggtatattaaagaatagaaaggacgaaaaaatgtgatacagattcggcaattatctcatgatcaacctctgccaatggatcttttactattagctgatccttcaaaggaaaaggttttcacttatgtacaatccggctcttgttatgccgcttttcatgaagaggatgtgattggtgtctatgtgctatcatcgctctctcagcattcagtggaaatcatgaatgtggctgtgaaggagtcatggcaaggaaggggaattgggaagcagctggtccgccatgcgatcgctgaagcgaaagctgctggttttcatacgattgaaatcggcacaggcaactcgagtattcagcaactcgcactttatcaaaaatgcggcttccgcctaacgtcgatcgatcgagatttcttccttaagcattatgatgaaccaatttatgaaaacgggattcagtgtatagatatggtacggctgtcactcacatttcaagcagactgactttttgttcagcctgctttttttatgctcttcgctttttcacagcatgaatcacatattgaatgaataagtaaagcacagcgccagctaaaaagcagacaacgcatccaaaaagcgtcgcctcagagctgaattgatactcttcaattttcatgatataaaatggcatgccaaacagcgttggacttgattcgatatgattgacctctaacagtagtaaaaagacaggggtcataaacacagcaaatatatacagcatcgcaagtgttaagccgctagaaaacgaatgaaatactttgatcatctctttctctccttcatctcttttaaactggctgtgatatttttcccgtctgggcaagctggatgcagcatcacagtgttcagtaaagaaaaaaacagcagctgatgactcaccggatgcttccacatcaaaaaaagcacaatcgagcagagtaccggaaacagtggacctgcaagtgccaccatcaaattaaagctcggccgggcaaatgtctcatgaatgatcgccacatgcttccaatcaatcgttaccacaaaatcaaagagcggccttttttcgactttgttacataccatgatcatcagcatatgaccgagttcatgtatgagcacaaccgctagtaagctaatgacaagccccatcatcgcaatatcggcctttttaacatcactgcatatatacaactgaaaaagacaagtgaaccaagcagataagcggtggcaagaagaaacatattagctgacagccactctaataaaagcatatcgatgaagctgaatacagctatcatcatcacgatgacaaatagtttattaaaatcactgattttcacgacaaaccctgtacaggctgccatgacggtcatgaataaaatggacaaactcgccaagccatgaccttcactttcaattccaatcaccaaataagcaaggctaatatagacaaaataaatgagtaaattgattgtgtaataaaataaaattctcgacaatatatacgcgccctttgatgtatttaacataaagatggcccgttgattgagatgatattctctgccaatcatcagtggaagcatgatcaatatttcctttaacgcaaactgcacaataaaggcatacagccatccagtttcttcaggtgtaaaaacaaatgggagcatagccgtcaaacaaacgagaaagaggaacaaaatgccttgttctttaaaaacagctgagcgaatgaaatagaccatttcctgccgcaggtgcgtcagaaaggaagaatacgtcctgattttctggtaagaaaacgactttatctctgttttcagctgcaaaaacatttgatgaacatagcaagctgctaaaccttttacccatagccatccagcgcttagaaggatcaccagcaacgtcagatagacagccggccatacacggatcatctccaccgctttttgaaaaagaagaaatatgagtacttgaagtgccgcaaagccgatcgtttgcagcagtaaatgctcctttgtttttgatacgaaatgacttacaccgatccgcaacagcatccatgaagagagcgtataaagtgccaagatgccgcatgtgatgcagacaacgatgatccaatacaaagatgggatgacacccgtgattaaaagaccaaatacaatcggtaaaaaaagcagtccagccatgaggtagcaaaaaagcactggaaagaaatacgcacaaaggacaaagggtgcactttgtatcgcactgttcaaaaagtagaattgatattcttggcgcttcagtttatttcgggataacacaatccctgctcctaatagtaagagcgacattttgacaaattggatgtatagcgcagccggctctctttcacctgcctgcatgtaaaagcgcaggctgatgacaatgtatatcgcatagatgagcaagagaaaaacggcggctgcgagaagctgcaaaggatacttttttccaagctgctttcctttcgttgtcagcataccccattcgattttatgaagaacgtgtcgtgtccaaatcattgagtaacctctccacctgcatatagtaatctcgatttacttctttataaatctcttcaagtgcctgatgaggatatgtctgattcgtttcttggcgggacatattcagcttgacgtcaccatttcttaagatcatgagatgatcatataatgtatcaccaaagctcaaatgatgagttgaaattagaatgccagcaccttgatctctcagcttcatgagcaccttttttaagatgatcatcatatctggatcaagtccgttcgttggctcgtcgaacacataataatcacacggtctgaggagctgcgaaatgatctgtgttttcttttgattgccatgggacagctgagcgattggttgatccatatacggactcagctcaaacaaatcgatgaatgtctcttcacgtgtgacatcttgctcatgtggcagctgaagtaattgaaagtattccctcggtgttaaataatcgaacaacgcatgatcatcaggaacataggaaacatgttttttcaaaagggaaatatgtgctgaggattgaaggttcagctgttcaccatgtaaggaaacgcagccagtaaatggcgtcagcccaaacatagcttggatcattgttgtctttcctgccccattgtgtcctaaaagaagcatcatccggcctttctccacgttcatttgtatatggcggagagagaaggtgcggctatacgttttttcttgtaattgtaatgtcagcatcatattcctccgtttgtttcagatggaacagatggcctcgcatctgttctcatccctgttagaaaccgcatttgattttcacgtacatgcctaagaacttgaattcgcctaaaaatttagagccttttccaaaggtcttgcatgcccaaatcaatgctgcgactgtcacaatacctaaaatagcggcaaggacataaatccaaaatgcatttttctgtacgttcttagaagttagaattcgttgcttcctttcatcataggccgccagtaggtgaaggacatacatatacactcctactggaaaacgaaggctaaaaggattcagcatctcatcaccccctaatatatgtaaaatgataccatcccccatacagaaaacataagttcatttcagatcatatttttagtcgatttttcatgatctattgcttataaatagtcgagctgcgcgctttccctctgaccgaaggacgactttttacaaaaataggatgcgactattgaaacagctgcgggatctcattcaacaaaaaaacgctgcgcccactcttatataagagcggaacgcagcgcgtggcattacattatttattcaagttatagaatgtttcaatgccgtggtattgagctgtttcagccaattgatcttcgatgcgaagtaattggttgtatttcgccacacggtccgtacgagacggagcaccagttttgatttgtccagcgtttgttgcaacagcaatgtctgcaattgtgctgtcttctgtttcaccagagcggtgagagatcacagctgtgtatcctgcacgttttgccatttcgattgcatcaaatgtttcagttaatgtaccgatttggtttactttgattaggattgagttaccaacgccgtttttgattccttcagaaagcttcttcgtgtttgtcacgaataagtcatctcctactagctgaaccttgctgccaaggcgctcagttaatagtttgtgaccttcccagtcgttttcatcaaggccgtcttcgatcgagatgattgggtatttcgataccatatcttcataccagtcaaccatttcagcagatgttttcacaacaccttcgcctgataaatgatatttaccgtcttctttgttgtagaactcagaagatgcagcatccattgcaagtttcacttcttcacctggtttgaaaccagctttttcaatcgcttctacgattgtttgaagtgcttcttcgttagaaccaaggtttggagcgaatccaccttcgtcacctacagctgtgtttaagccttttgcacttaatacagatttcaggctatggaagatttgtgcgcccatgcgaagtgcttcacggaagtttggggcacctacaggcataatcatgaattcttgaatgtctacgttgttatccgcatgctctccgccgttgacgatgttcatcattggcactggaagcgttttggagttgaatccaccaaggtattggtaaagtggaatttgtaagaaatcagcagccgcacgtgctacagcgatagatacgccaaggattgcgtttgcgcctaatttccctttgttttctgttccgtcaagttcgattaacattttgtcaattgctacttgttcagtgacatcaaagcctaaaagctctggtgcaatgatttcgtttacgttgtttacagctgtcagaacaccttttccaaggtaacggtctttgtctccgtcacgtagttctactgcttcatattcacctgtagaagcaccacttggtactagtgcacggccaaagccgccagattctgtgtaaacttctacttcaactgttgggttaccgcgagagtctaatacttcgcgtgcatatacgtcaacaatgtatggcattgttatttctctccttttgaatcaatttgttatttctgaatcaatgatgttcctgtcatctcttttggtttttcaacaccaagtaagtctaaaagggttggagatagatcggctagaatgccgccttctctaagcgttgcaccttttttcgttacgatgactggaacagggtttgtcgtatgtgcagtatgcggctttccttcttcggtaatcagcacgtctgcgttaccgtggtctgccgtgatgatggcatgtccgccttttgctaggattgcgtcgacaacagctcctaagcactcatctactgcttcaatggctttgattgttggctcgagcatacctgagtgaccaaccatatccgggttagcaaagttcaggatgatcgcatcatgcttgtcagcattgatgtctgcaacaagtgcatcctttacctcataagcgctcatttctggcttgaggtcataggttgccacatctggcgaattgatcaagatgcggtcttcaccaggaaattcttcttcacgtccaccgctcataaagaacgtcacgtgaggatatttctctgtttcagcaatccgcagctgtttcaatccattttgcgctagcacttctcctactgtgttatccaaattcactggtttgaaagcaacatagccatcaaccgtttcactgaagtgtgtgaagcagacgaagtgtaaattcttcggatgtgctaccccgcgatcaaatgagcggaaatcttcatttgtgaaggtgttcgaaatttggatcgcacggtctgggcggaagttatagaaaatcacagaatcgccgtcgtttactttagcaactggctcaccgttttctctcgtgatgacagatggaataacgaattcatcgtagattccattttcataggagtcatcaacgacatcatagatgttttggtaacttgggccttcaccatacgccatcgcgcgatatgctttctccacacgatcccagcgtttgtcacggtccattgagtaatagcgtccagaaagtgttgccacttctccgacaccgatttctttgatttgctcttcaagctgttttaagtacactttggctgtcttctgaccaacatcacgtccatccaagaagccatgaatgtatacttttgttaagccttcttttttcgctagtttcagcaaggcaaaaagatgctggatgtggctgtgcacaccgccgtctgacaagagaccgaataaatgaagggccttgtcattctcttttgcataagtcattgcctctaggaacgtttcgtttttctcaaattccccatcacgaatggcaacattcactcttgttaagctttgatacacaatgcgtcctgcaccgatgttcaaatgcccaacctcagagttccccatttgaccttgcgggaggcctactgcctcacctgaagccgttaaggtttgatgcgggaattcgttccagtagcggtcgaagttcggtttctttgcttgggcaacagcgttaccgactgtttcgcctcttaaaccgaatccatctaagatgattaatgcagctggtttcttactcatattgaccttcctccaataattgaacgaaagactgaggttctaagcttgcgccgcctaccaaagcaccgtcaatatcggattctgccatatattctttaatattcgcaggtttcacgcttccgccatattgaatgcgaaggctgtctgccgcttcttgaccatattcacttgcaaccgtttgacggatatgcgcacaaacgtcgtttgcatctttcgctgtagaagatttccctgtaccgatcgcccaaattggctcatatgcaatgacagattcagcgacttgctgagttgttaaaccagctagtgctttcttcacttgatcagcgacaagttcatttgttttgccagcttcacgctcttcaagcgtttcacctacacagataattggaacaatgccatgcttgaatgcagcatgtgcttttttgttcactgtttcatctgtttcagcaaagaattcacggcgctctgaatgaccgatcactgagtagccgatgccaagatcttttagcgcagcagggctgatttcaccagtgaatgcaccattttcttcaaagtgcatgttttgtgcaccaattttaaggtctgttccgttagaaaggctgtttagcttttcaaggaaaagggctggcgcacagacaattgcttccactttgtcaggagatggaatggatgacttgacttcttcaacgaagctaaccgcttcgccaagtgttttgttcattttccagttcccagctataattggttttctcatgattgacacttccttatagcagttttggtcttatttatcgtttaatgcagtaacacctggaagctctttgccttccataaattcaagtgaagcgccgccgcctgtagaaatatggctcatctgatcagcaagaccaaatttctcaacagctgctgctgagtctccaccaccaatgacagaatatgtatcttttgcttctgccagtgcttctgcgattgcttttgttcctttagcgaatgcgtcgatttcaaatacacccattggtccgttccaaacaacaagtttgctgtttttaatgacatcagcgtacttgcctattgtctctgttccaatatcaagtgcttctagatcacttggaatttcagagattggcacaatgctcgtatttgcatcatttgaaaagtcgtcggctaccagaacatctgttggaatcaggaagttcacgcctttttcttttgcacggtccataaaggattttgctaaatcaactttgtcttcttctaataaagattttcctacttcgtggcctagtgctttcacaaatgtgtaagcaagtccgccgccgatgatgaggttgtccactttatcaagaagactttcaatcacaccgattttatcctttacttttgcgccaccaataatcgctgtaaatgggcgatcagggtttgaaatggcttttcctagaacctcaagctctttttgcatgaggaagcccgaaacagccggaagatatgctgcaataccagcagtggatgcatgtgcacggtgtgcagcaccgaacgcatcattgacatacacatcagctaaatcagcaaatgcttttgatagttcaggatcgttcttttcttcaccaggatagaaacgaacgttttcaagcactagcacatctccttcttttaagtcagagatttgctttttcacgttgtcgccataagcttcatccgcttttttcacttcttgtccaagaagctcttgcagacgtttcgctacaggtgtcagacgcaattcttcagtaacttgacccttcggacgacccaaatgactagctagcagtacctttgcgccttgtcctgttaaatactcaatcgttggtaatgctgcgcgaatacgagtatcatccgtcacttttccgtctttcattggaacgttaaaatctacgcggcagaacacaactttaccttttacgtcaatgtcttttactgatttcttattcatgctcgtcaggagatcctcctttattctggtttccttacgcattggacaagtctctctttatccttttcccattttgccctcatcaaaacgagaaatcgtgcagaacggataaaaacagagaaaaagggaaagggatgcttccccttcccttgtccgtcttcattatatcgtgtctctaggaaagaaccaagtgagttccttcagtgtgacaaattaaagaccttgttttgcaatgtaagctgcaaggtcaacaacgcggtgagaatatccactctcgttatcgtaccaagaaatgactttcaccatgctgccttccattaccattgtagaaagagcatcgattgttgaagagtttgcattaccattgtagtcaccagatactaatggctcttcgctgtagccaaggattccattaagttctccttcagctgcttctttaagtgctgcatttacatcttcagccgttacatcttggtttaattcagctacaaggtcaactaaagaaacgttaggtgttggaacacgcatagcgccaccgtttaatttacctttaagttcaggcaatacaagtgaaacagcttttgcagcacctgtagaagttgggatgatgttttccgcagctgcacgagcacgacggtagtctttgtgcggaagatcaagaatttgttggtcatttgtgtatgagtgaacagttgtcatcataccgcgtttaatgccaaatttatcgttaagtacttttgcaaatggagctaagcagtttgttgtacaagatgcattagagatgacatcgtggctagctgcatcgtatttgtcttcgtttacacccataacgattgtgatatcttcttcgttagcaggagcagagatgatgacttttttagcgccagcttctaagtgttttgcagcgtctgcacgttttgtgaagaatccagtagattcaacaacgatttctacgccttgtttaccccagcttaattttgcagggtcacgttcagctgatacttcgattgttttaccgttcactactaagttcgtaccgtctacagaaacctctgcatctagttttccgtgaacagagtcatattgtaaaaggtgtgcaagcatgttagcgtctgttagatcgttaaccgctactacctcaacttcaggattgtttaatgctgcacgaaatacgttacgtccaatacgtccaaatccgttaataccgacttttactgccatgatgtttcctccttttataggtcacaatgttttatattgagggatcaattgactcccttaataactcttttgcggctccttcgtctgtgacgagaaccgttcggcggggttttttgaaataagcttcaatggcccctgcctttgatgatccacctgcaacagcaatgatgtgtggaatgctttctaaatcatctagctgcatgccgacggagtgcactttgtggacgacctcaccatcacggttaaagtaatagccaaaggcctctgtcactgcgtcatgctcatcaatcttttttaaatcttcagctggtgtgtttcgtctcatcgccattgtttttgcttcaccgattccatgaatgagcatcgtggatgatttaatcgtttgaagcacttctttgactgatggctcttcaataatggaagagtaagcaccttctgacagctgtcctggaacaaacagcagtttgtaagtaccggaagctttttcagccatgtgggcacaaatggtgtttgcctgattttttacattctccccaagaccgcctcttgcagggacaaacatcatgtctctgtttttggcatcaggggtcatcatttcggcaacggcttccatcgtcgttccgccagtgacggcgacgatattatttccagtaaacctttttttcatacactggacagcagctcttcccatttcttgcttcacccacggggattcgtcactgtcaccagaaacgatcatgacttcttctaggcctaacttcctctttaatgtattttccaaaaaggttaagcctaaaacgtccttcatcattccttcaagcatttcaagcaaagcatgaccttcagtcgtcagcatcataccgctcgttttgacatccagcagattttgttcttttaagaactgaacttcagctcttaagatgcgttcactgagacctagactcgtcgcaaggcttctgcggccgattggttcagctagcctgatgtattgcaaaatatcgtagcgtttttgcataactgtgagaagatctggcaataattttttttgagcttccaataaacgattcatggctaacgaccctttcttttcacgttggactaaaaacgtcccactgtgacaaaaaacgtcccgccacagccaaaaaaaatcaatccctgctttctttaattattttaacaggataatcttgcattttcaactcttacaaacacattcagacaaaaaatagacacattttcaccgataacctgcttgtcatcaaggttcttgctatgatatttcttttcaaaatattttattttcttctatattgaatgaattcatccatgaaagtgtgcatgcgtaagagatccgcatgcacattttttggtctagtcggtcttttatgtttttgggattccttcctcttcggcgaaacgctttgcctcttccttcggtttgattttgagataataaatgatgtagcaggctgccatgaacggaacgccgcaataaaggccaatccgctgatcctcaataaagaataggctgatgagcacgatgccaaatgcgatgaagcctgctagtgggacaaatggataaagtggtgtacggaaaacaagatcctttacatctccaccgtcttttatgaattgttttctaaagaaatattgagacaaacaaatggacatccacaccacaacaagaaccattccagaaattgaaataagccacacatacaccgtttttggcgccacaacacttgtgagcagagatagagcggatacacccattgtcaccaataatgcattgattgggattttacgcttggacagctttttcgtaaagtcaggtcctttcccgtcctttgaaagcgaccagagcatacgtgatgatgcatacaatccagagtttgctacagataagacagctgtgataataataaaattcatgatatctgcagcatatgggatgccgaccttgtccagcacgaccacaaacggactgtcgacagcgcctgctgtctgccatggaagaagtgctgctaaaaccgcaatggataaaacgaaaaagaccattgttctccaaataatatttcgtattgatcgaggcaatgttttttcagggctttcactctcacctgctgcgatccctacaagttctgttccttggaaggagaaattgacggtgaccatggttaataaaatagcaaaaacaccattaggaaatagtccgccatgatccgtcaaatgacgaaataaaggggctggttctccgccttttaaatggatcattccgaaaattgcgccaattccgataataataaacaataggatggccgcaaccttgatggctgaaaaccaaaactccgtttcagcgaagctgcgagcagagatggcattcacggcaaataatatgacgctaaatgctagacaccagagccaaaccgggatatctggaaaccacctttggagcaatatgcctgctgatgtaaactccagtccaatcgtacacgcccagctaaaccaatacagccagccgatcataaagcctgtggacgggccgatatatttggttgcatattcctgaaaggaacccgctgtcggcatcgccactgctaattctccaagacacagcatgaccaaatacattaaaaatccgccaatgataaacgatagaatggctccccctggtcctgcctgatgaataatcaatcctgatccaaggaaaaggcccgtaccgatgacgccgcctaaggcaatcataaagagatgtctgcttttcatggaacgctctagttcattatgctgttcttgcatcaaatccacttccccactttccctcttctattcatcatcctttgacaaaattcgctgttcattgaaaaagaaagggagaaagtgaagcttcctccccctttgtcatttaagcttgaaatagtgcttcaatatgaccaatcgcccagtctaaatcttcttttgaaatggtcagtggtggtgcaaaacggatgactgtttcatgggtttccttacataacaatcctgcttgcttcagcttttcacaataaggtctagctgcctctgtcagctccatgcctataaatagtccgcggccgcgcacttctttaatcacaggactttgaatgcgtgacaatttgtctttgaagtattcgccaagttccatcgagcgtgctgcaagcttttcgtcaattaaaacatccagtgcagcaagcgacaccgcacacgcaagaggatttcctccgaaggtagacccatgagaaccagggttaaacacgcctaaaatatcgcggtttgctacaacacacgagattgggaatactccgccgcctaaagctttcccaagaatcagcatatctggctcaatgtcttcccaatcacacgcaaacatcttacctgttcgtgctaaccccacttgaatctcatccgcaatgaacagcacatgttcttgttcacaaagcgctttggcatctttcaagaaaccttctggcggcataacaatacccgcttcaccttgaatcggttcaatgaggaaagccgctgtctgtggtgtgatcgcttcacgtaatgcttcaatatctccgtaaggaatcagcttaattccaggaagcattggaccgaaacctctctggtattctgcttctgaggaaagagacacagccgtcatcgttctcccatggaaattgccaacacatgcaatgatttctgcacggttctcttcgattcccttcacatcatagccccagcgtcttgcggcttttacagcggtttctacagcctcagcacctgtattcattgggagtgccatgtctttattcgtcagtttgcaaattttttcataccaaggaccaagctgatcattatgaaaggctctcgacgtgagtgtcacgcggtctgcctgtttttttagcgcttcaataatgcggggatggcgatgtccttggttcactgcggaatacgcactcagcatatccatatatcgattaccttcagggtctgtcacccacaccccctcagcctctgaaatcacaattggcaacggatgatagtttgccgctccatattgctctgtttgttgaatcaattcatttgtctgtgtcatgatctattcctccttctgtaaggtcgcttttttcaattgggttgatcttcatccatatgttatgcaaggattgtgccaactttctgaccgcttgatcataagggtctacctcattcattccgcaaaatttatttgcatatgccaaattttttagaggaaaccgcaaaatttttcatgtaaaatagaggtaacgtcaggaggtggcgcaagtgaaaaaagatctgcataccgcaaagcttgaaaatgagattgatttatataaacaaatgctcgatttaattgatgtcggggttcatgcaattgatgagaatggacatacggttgtttataataaaaaaatgatggagatcgagtctttaaaacgctctgatgttctccataaaaatgtgctcgatttcttcgcctttcaagatgagatgcacagtacacttgtccaagcgctgcgtaccgggaaacaaaccgtacatgccaagcagacgtatcataattacaatggaaaagaaatcacaacgattaaccatacatacccgcttgttcgagacggtctcattcaaggggctgttgaaatttcgaatgatgtgaccaagctggaacggctgattcatcacaatatgaagaagaaaggaagcactcgctttaccttcgactctattattggacaaagccctgcatttttagaggtgattgagcatgcgaaacgagcgacacgcacctcttcttatgtgctcattgttggcgaaactgggactgggaaagaactgtttgctcaaagcattcataacggcagcagccgggcatctggaccatttattacccaaaattgtgccgcactgcctgataatctgattgaaagcctgctctttggtacacaaaaaggggcttttacgggggcagctgatcagcctggcttatttgagcaggcgcaaggaggaaccttgcttttagatgagatcaattcactgaatcctcatcttcaagcaaaactactgcgcgtcttacaggagaaacgcgtgagaaggctgggcagcacaaaggaaatcgctgttgatgtaagagtgattgccaatatgaacgaggaccctgtggatgcaatcgcaggcggtcgcatgcgcaaggatttattttatcgtctcggtattgtcaccttatttattccgccgctttctgagcgaaaagaggacattcctacgtttgtgaatcattttattcaaaaatataatgagctgtttcaaatgaaggtgaaggcggctgatgaagaggtacttgccctttttaaggcgtatgattggccaggcaatgtaagagaactggagcatgtgattgaggcggggatgaatatgatgatggatgaagacgacttaggcatgcatcaccttccctatcattttagatttaagcacggggaaggccgtcctaaggcgcaattgcaaacaaattctctgcagcaaaccgcagctgctgacacctttgtgtatacaagccctgaacagacgactgatttccaaacccaaatggagcggttcgaaaaacaatacatcgtccattacttagaaaaaatggacgataatatttcacagactgcaaagttattgggcatgagcaggcaaagtctgcaatatcgaatgaaaaagctacatatttctcttcaataatagagctgtgccatcattcggcacagcttattgtgtatctgactgttctgctgggttttgcagcacatcaccgagcagattttctacattttttaaatgcgtaagcatcgctttctctgcttcttctggctgccttgccatgacggctttgtaaatttgttcatgttcttcgtaaagcttctgaatggaggctttcgttgagaataacacgactttcctcgtttcccgcatcgtttctactaacaaggttgagacttgattcattaacacctttaatacgtcattcttcgaggctttggctaatgcaagatggaaggtaagatctgcctcttcaccaatttcttcatgggcttctgcctgcctcatttgttcgagtgcttcacgcagctgatgaaggtcatcgtccgtccgaaacagcgccgcctttttgacagcacctatttcaataatggttctcacttcaaggagctgcctgacatcatgctgcttcattaaaaatgcaggggataaagaaaatgcgagctgttcaggatcgaactgcttcacatatgtgccttccccttgtttcatctctattaatccgatcgctttgagagcagacagtgcctctctcacagcggaacggctgacttgaaagctttctgagagcgcttgaaccgaatctaatttttctcccggaagaagctcaccagtgcgaatggattcaattaatgcatccgcaatttcttcatatatttttttggttttgatttgtttatatttcaattggtctcacctcatcactgttgtctacccttatcggctcatgccctatcttatactttaccccaaaatttccgttcacacgtctccccgatttaattttcaaaaaatcttctgtgtgccttgcttccaattaaaaaaagcacctgccatgtttctggcaagtacttctttttaatcatagcgcttccgcagtgtagatgatggaagattcatttgttcacgatatttcgcaatggttctgcgcgacactcggatgccaaaggtttgctgaagctgcgtcatcatttgctgatctgaatacggttttttcttattttctgtttggatcagctctgcgatgtacgtcttgactgtatagctggacgcctcttccagcgagggtccttctagctttgcttggaaaaattgtttcatttccatgaggccataaggggtttgcaccattttccctttcaccgttcggctgactgtggactcatgcacttgcaatatatctgcgatacgcttcatcgtaagcggtttcattttatgtttccctgtaaggaaaaaatctgtctgatgtaagataatctcacgaacgacatgagtcatcgtttgttttctttgcttcaacgcttggactagccaattgtactgctgctctttttcctttaaatacacatatgcttcatgccgcttttggtcttgcatcatggcgaagtatccttcattcatttcaacatctgggaaagcgcgctgattcagctcaaatgtgatgtggtcctgcacgacagtaatcgtcacatccggctctatatacacatggtcttcttcgtatgagaaatggatgcctggtcttggctcaagctgcgacacctcatcttgtaccgcttgaagtgttttcatagaaatgcctgttttcgccgcaatttccttccatgcctttcttgcaaagagaaagaagtgctcatcgatgatcagctcggcttcataccagcgctccttttttcttctcagctgaagcaggatgcattcttgtaaagatcttgcacctataccggcaggctctagcgattgaagctgatgaaggacggcttctacttcttcagctgacacctttaagacagctgccatctcgtcaaccggttcatttaaatagccattggaatcaatggactcgatcataaagtgaaagatcctttgatttttttcacttagattcaaatcaatggcttgtttctttaaatacatttgcaggctttctttttgatgcgttcgatacggctctgtcattcggtcttgagattttttatgataaactggttgatagctgtccgtgtctttccgctcaatcagagggttctcaagcgctaactggtcaagatactcgccaagctcagtgctattcagctggagcaatgtaatggcctgcctgagttcttgtgtgagcacctgctttaatacttgttcttgttgcagattaaggctcattgtctcccctccctctcatcattttacatgaagattgacggaccgtatatacgaaataggagtgattcccatgtctgaacttttttccgttccatactttgttgacaacttgaaacagcacatcaccatgaatcaaaatgaagacaagattcatgcgatgaatgcctattaccgctcagtggtgtcaacgcttgtacaagatcagctgaccaaaaatgctgtggttttgaagcgaattcaacaccttgatgaggcgtatcaaaaggtgaaaaaagaaagcgaatgaacgaacaagaacaccctttgtcatgatggcaaagggtgtttttcatttgcgaaaagcttctgatcgagccttgatttgtacatcatcaaaaagccagaccgtccggtagtatagatgataaaagcaaaccatagtccgtgattgtgccaaataggcgtaactgctgcttgaacaacgataaacaagatcatcgcaaacagcatcgaatttctgacaggggcaatttctgtcgcacctgtaaatacgccgtatatgaccaaaccgaaacaagcggcaaacggatagagaacgagccagtctgcatagcccaatgtcacatctagaagacgcgggagatttgtaaacaagcccaagatcggctcttttaagagaaaatacaacgacgcaatgaggcatgccatgacaagcgcccactgcctcgaaagagttaacgttctctcataaagggtgcggtcatttgcaccaactgacctgcccacaaggatgctggatgcattggcaaaaccatcgaacaaataagccatgatgtagtgaatttgaaataagatggcattggccgccaacatttctgttccaaaagaagcgccttttgctgtaaacatgttaatcacgacaagcagacaaatcgtccgaataaacaaatctttattcacatgaaacattttctgcactgcccgtgtatccatgattttcttaatagacggcatctggaacccgttttttgaatgcttcatgatgatccatgcgcctagtacaaaagcagttaattcagagatcaatgtcgcggccgccacccctttaactgcaaacgaaaacacatgaacaagcagaagagcaaggaccatattcatgacattgatcaagatttgtaaagagagggcttccttcatttttgccattcccatcagccagcctaatatcacataattcatcaaggtaaacggtgcaccccaaatccgaatatgaaagtaatctgctgcaaattgccgaacatccgcagcgggagagatcacgagaaaagcagattgaataatgggccattgcagggcaataaaacaaagaccgacaatgatggcgattaaaaatggtctcagaaaagcaagtacaccctgctcttcactctgcgccccgtttgcctgagcagcaaaagcagatgtactcacccgcaaaaaaccaaagagccaatagagtgtactgaaaatgagactgccaactgcgacgcctccaatatacgcgggattggcaagctgaccaacaacggctgtatcaacagctccaagtaatggtgtcgtcatcgttgagatggttaaaggaatggctaaagctaaatacgctcgatggttcacgatgctacctgcctttcatgaaaaatagcctcttctaaaagaggcattgatgaaatgacgatttatcgaactggtctgccaatcgttcgggacaaaggatggtctgccagcattgcctctctcatcttttgcaccgctttctcttctgatgaaaagaaatcatcctttgatcgaaattgtgcaacaagttcaccttgatctaatatcgccaattgatcacttaagtgataggctgccgtcatatcatgtgtaataaataagtaagcgacacccagttccttctttaattctactaataaatctaaaatgacaccctgtgtgaccatatctaagctgctgacggattcatccagtacgacgagctttggctgcaacaataaggctcttgcaatgttgatcctttgcagctggccgccgctgaattgatgcggatatttagacaagtccttttcactgagcccgactctttccagccaatggatcagcacgcttttgcgttcttttcggctcatcgtttcatagttttcaagcggttcggataaaatttgttcgacggtccaccttggattcaccgccgagtatgaatcttgaaacaccgcttgcacatgccggcgataatgtttgcgtgttctttggtctgcacaatatatatcctgaccttcaaagagaacctgaccggcttttggcttctctagaccaagtatgatacggcctagcgtgcttttccctacgccgctttgccctagcaatccgacgcacgtgccttcttcaacgagcaaattgacgccgtttaagacttggtctgcgcctttttttctcatcagaaacgaccggctgttgtatgaatgactaactgctttcacttctaataaatgcaatggccttctcacctcaaatcggacaaacagctgggatggatggacgagctgctaatagtttctttgtataatcatgctttgggttttcaaaaagctcaagcacttctgctttttctactatttctccctgcctcatgacaacaacctgatctgccatttctgcaatgacgccaaggtcgtgagtaatgagcaaaatggcggttccatactcatgacgaatgtggttcagatgctcaagcaccagcttctgcgtgtgtacatctaaagcagttgttggttcatctgctatgaggagaggcgggtgcatacaggcagccatggcaatcatgacacgctgcagcatgccgccgcttagttcaaagggatacttgtttaacaacttgtctggctgcggcagattcatttgcgctagcgcatccattgccttcgcttttgcctgccttttactgacagaggtgtgctggcggatggtttcaatcagctgatgaccgatcgtccatactggcgtaaagctgttcattggattttgcataatatatgagatgtccttgccccgaatagaccgcatatccctttcactcagaccgatcaattctcgtccttttaatgtgatgctgccagtaacatccgttgttttctggtcaagcatatgtaagattgacatacttgtcaccgttttcccgcagccgctctcacctattaatccaacgatttgacctcgccctacttcaaacgatacgtcctgaataagagaggttgtcccatgaggcgttttcgactgcacatgcaggttctctatttgtaaaatggactcttgcacattgatcattcctttacacacggcgtttgataccatatttctctgaaagggcttctcctagtaaattaaagaggacgacgacagccatgatgacaagacctggatagagcatcaactgaggattcgtttgaatatacgacttcccttcatggatcatcgctccccattcaggcataggaggctgaacgcctaatccgagaaaggacattgctgaaatgtccataatcgcccagcccatttcaagtgtgccaatgaccgccagtggcggcaggacatttggaatcatatgctttttcatgatgttccagtgggatgtcccgctaattttcgcagcggcaataaagttctgttcttttaaactcagcaccattcctcggaagacgcgagcatagtatacccattgcacaagcatcaaggccagcacgacttgagtaagtccaggaccgaagatgccgactaatccaaggatcagcaccaggttcgggaatgccatgattccgtcgcagaatctcattaagacgtgatcgacccagccgcctttgtaacctgacaacaaaccaacgattaacccaatcaataaagaagagagaaagattaataacgcacagcctagcgaaacacgtgccccatataaaattcgggataaattgcatcggcctaattgatctgtcccaagaggatattcccacgaagacccctttagcttcatcgctagattgacagccgccggatcatgtggagcgatccacggtgcacatattgtcacaatcagcaatagaccaaggagcaccacgcagatcgagatcatcttttgatgagagaagagatattttccttttgtcatcatgactggcggccttcctttctggaaatacgggggtcaatgatcagctgaagtaagtccacaatcaagctgctcaagataaagatacctgctgccatgaggacatagaattgaatgaccggcagatcccggttaaagattgcttcaataaagaagcgcccaaaccctggccatgaaaaaacagcctctacgataatagttcctgtcagcagcttgccaagattcaccccaagccctgtcagcattggcgatatcgcgattctcaatacatgcttgaacatgattgaccgttcctttaatcctctaattctcgcatattgaacaaacggctcttgaagcacctcactcacacttgagcgtaatagccttgtatacattgcaattaaagggacagccagtgtgaccgatggcagaatgagatgctcccatgttcccaccccttcaaccggtagaagatcgagcttcactgaaaaaaagaagatgagcaaataccccaagacaaatgtcgggatcgatgctcctaagaaagaaatgagccggctcacatgatcaacgatgccatttttcctcataccgctgaaaaagccgagtggaatgctgacacagatagcaatcagcaggctagtcagcgccaattgaatcgtcgctggtattctatacatcacctcattgagcacaggctggttagacatatatgacttgccaaaatcaagatgaatgactttttcaatggtgtgaagatactgcatataaaacggttggtctaaaccaaattcacttcgtttttgcgctaatatttcatccgttggctggatatgagccgctgctaaatatgcctcagccgggtcaactggcgaaaggtgaatcataccagtcgtgaaaagagtggctaataaaaatacagggatgattgatagcatgcgtttgacgatatagcggcccatttcctaaccttccttctattacttcagcttaatacctgtgaatggatgttcatcgcgatttgctgggaactcaaagtccttcacatttttttgataaacggctgtctttttaaaataagagattggcacaattgcgccttgatcctgtaatgaagataagacagacgaataaagtgcttttcgtttgttttcattggttgttgatggaatttcgctcatttctttgatcagcttgtccttatttggataggctgagatggcttctttgaatccaaaaccatctgatgagacgacgttcataaatgtatgcggatcatatggtgctccgtagttgctaaagaagttcatatcaaacttgttggctttaaagcgctgcacctgtgttgccagctctacaccttcaagtttgacgccaacgccaatggcaccccattctgcttgaagcgtctcagccatcgctttttgaatcgattctgctgaatcatacatcatactaaattcaagcgtttttccatctttttcacgaacggtttttccttttggaagtgtccagcctgcttcatccagtaatgctttcgctttgtctacatcatattggaacggcttcacatgaatatcagatgtgtaaggcatgttggtcggcaatatgtgatctgcttcatcctctaagccagaggtgacaccctctaccattgatttcttattgatcgcatattgaagggcatgtcgcactttctcatctgacagctgatcgacttttgtattcatgacaagctgtctcgttgctacaggttctgacatttttgtttcatacttaccgctcgcctctaactgtttgtaggcatctaggctaatggtaccttctccgtaaaggacatctacatcacctttttcaaatgccatgactctcgtttccgcatctgggatgaccttgactttgatttctttgacctttggcttttctccccaataatgttcatttcgttcgaaaatggcatagtcatctttttgatatgtttttaatacccaagggcctgtccccactggtttttcaattccttttgacgtatctccgtttttagggaagcctgcttcgcctaagaaacgaaccgggcggacaacggctaattcttgaacagttggataatatggctctgttaatgtgagttgaaacgttttcttgtctactgcttctgtctttttgattttttttatcacacctaaccagctatgtatgtccttgttttttaagatggaatcaaagttctttttcacaatgtttgcattaaactcagatccatctgaaaatgtcacattgtctcttagatggaacgtgtacaccttgccatcctttgacacatcccatgatttcgctaattcaggttttagctttccattcttttgatagctgaccaatggctcataaatcattgattgcgcgaacagttgtgatgggttgtatacgtgcggattcatttcgccaatatctctcggccaggccatcgtgatcatgtcaggatgatccttatctccacctgctccattgtttgcttgagagcagcctactaataaaaagataagcaggaaagggatgactgtatttattttaattttcggaaaaaaatggatgcaaatcgacataagatgttcctcctaattgatgctgataatcattttcattttaaggaggaaggtccccgttgtcaataacatatttaaatcgaatcggcaatacttattcctatttattccactaattgatgaatttgataaaaaagagaggcaggctgcttacgagtgagcagcctgtgaagaggtgaatgttttttctcgcagggcatgacgaattatgtcaatgatacgatcctgttcagcttctgtcatacttgttccagaggggagacaaagccctgattcaaataacaactcagatacgggggtgcctttcgcagctgaataaaatggacaatcacgaaagagcggctgctggtgcagcggcttccatacacgccttgcttcaatctgttctttttctagtgcagcaatgatgtccactggagacgtttgcttatcacaatcaatcgtcaatgtcgtcagccagcggttggacttggtgttttgatattctggcatgaaataaagcccctcaacatgagataacgcatcctgataacgcctgaaaatgcggcgcttttgttcaacacgctcgtccagtatttccatttgagcgatcccgacgcctgctagcaggttgctcatgcgatagttgtatcctatctcttgatgctcataatgcatcgcgcgttctctagcctgtgaagcgagaaagcggcagcgttcgatcgcagcttcatcatcactcacaagcattccgccgcctgatgttgtaatgattttatttccattaaacgaatagacaccgaacctgcccattgagccgcttttttttcctttataaagagcgcctaacgattcagccgcatcctcaatgactggtacatcatatgcttcacataacgccaagatctcgtccatttttgcgctttgtccatataaatgcacgacaatgacagcacggggcatttttccaagtcgttttgattccacaaaggctttctctaaagcaagcggacacatattccatgtatccctttcagaatcaataaaaacgggtgtggcttgttcgtataaaatcggatttgcagttgccacaaatgtgagggtggaacaaaagacaatgtcccctttttcaacgccaatcagctttaatgcgaggtgaatggctgctgttccagaagatagagccgctcctgcattcactcctgcatagcgcgcaactgcctgctcaaattcattcacaagaggtccaagcggtgcaatccagttacttttgaaagcttcctctattttcaaatactcttttccgctcatatgcggtggtgataagtaaattcgtttcctttcttgcatcatctcccgccctctctccgatctttgatttctattgcaggaatgcctacagcgactttctgatcgtcaatatctcttgttactgcggctcctgcgccaatgattgtccagcttccgatcgatgtcccgggtatcacaacagcacctgccccaatatgtgtacccattcgtaccgacacacagccagttaacactgctcccggtgatagatggacaaacgattcgagtatacagtcatgctctatgatagatcctgtgttgataatcgcatgttcaccgattgctgcatctgcttgaactactgccgttgccatcacgacactcccccttccaatgaccgctgatggacttacgaccgcccgtggatggatgagtgtggcaaatgccgtgttttcaaaagagaggcgttcctttactaactgtctgctctcattttgtccgatcgcaatcagccatttcatatgtggcattgcctctctcagcttttgactcatggagatcggtccatacaagatactgctttgagtgactgcctcttcaaattgatcatctaatacagcacataatgagtaatcgggatgggcagcaatcatgtcttgaatgactttgctatgcccaccagccccaattaaaccaattggttgctctttatatatcggttcctttgaatttttcagctgtggcatgatgcggctgctgcaccccctctgttttgatgactttcagcaaggtcatccataaaattttcatatcaagccaaaatgattgatgctcgacataccagagatcataggtgaatttttcctcccaggagatcgtgttccttccattcacctgtgcccatccagtaatgccaggcttgacaagatggcgccttgcttgctcctctgtatacatcggcaaatattccatcagaagcggccttggtccaacgagactgagctctccttttagaacattgactagctgcggcaattcatcaagactgagcttgcgaatcaatgcgcccgtcttagttaatcgtagatgatctggcaggagcaccccgtgctcgtcgcgttcatcgttcatcgtccgaaatttatatagcataaatggccggccgtacagaccaggccgcttctgccgaaacaacacaggcgtcccaattttccaccgaatcagtccataaagcacaagaaaaagaagactgcctgcgatgagcagcgtcaatgccaccaccacatctaacattcttttcatcatgaaatctccttttctcactagcgggaaacagcttgttttaccttacgcaccagctgctgccgctctcgttttgttcctgcaaattgatacaagtagcccatatagagaaagaaacatagacccccaatacaaaacagctcccaccaggacgtcacgtcataaatcgcttgaattcctgcacagacgccccaaatcatgagcgctcctgcaagtggaaccatcgtatgtttgtaaaagatggtgcgtttctgattcgtgatgcgggccgtataaaatggcagaaacacgatatttttgatcaataaaacaatcgctcctgctgatgcaatgccgtataaaccaagctgaagcgtatgcgtcaatccataggcaaaaagcacattggatacacctaatatgagcgtgaccactgccggaaccttcaatcgattaaaagcggtcgggacatatgtcagcggtaaaaacatcaaggttaagcataaataagcagcatgaatcatgaggagccatttcagctcttcaaaggcaggtccaagccacaaaagcatgagcggaccggcaagtcctcctagcagagccgctggaaacgcgacaaataacccgctccacttaatggcacttgctgcatatcggatgagaccctcttcatcttgatttgagtaaaatttcgtaatcgttggggcaaacacaaccgccaatgttcctgctagtgtgcgtaataataatggaaattgtaatatcgccgcatactgtcccgtcgcttccgctccaatgagcagattcgtcatcaataaatcaatttgtaaaaatagcaaaatccccatttgctcaaaagaatgccagacccctgatcgaacaagtgtgagactagaagatagtgaaacgtgccgccacttaaacgaaaaccaagggatgagttttttaaaataatagataccaattcccatagccgccaagcttcctatcacagccgcaagtggaatatgccagatggcgggtgccgtccatgtaaacagcagcacaatcatcagtgccctcaaaaacatctgaatggcctgaccaatacttgagacatataacttattcgcataaaacggcgcagccccaatgccggacatgacaaaattgagcataaataaaagaccccctaatataaaggcggtctgtgtgtcctttgcgagatcatcaggcacatgaagccactctaccagctggcgggacatgaagagacaaaacagaaaaagactgattgataaaaaaatggaactgacgaaataagatgagagatagcgctgcgccttctccatttcccctttatgagccgcaacagaaaaaaaacgcaccaccacagcacttaatgaagccgtaataaccgataaatagttgatcatattttgcgtcagatggattaagccgaatgcttccactccaagtgtatgaacgatatacggtgttaaacatacagacataagcatcatcaagacaaacgtcatgatgtttgcactggcattgtaaagaaacgctcgattcattttgatttcacgcagcgtgtaaaatccttcatccagcttcctctcccttttgtccgctcgttttcatcatctgatgaatcgcctctttcacagacgcctcattcggttctttcaatagcgtcaaaaacggaagatgggccacccattcatacccttccatcaccttatgatcaaatgacctgaggacaacacacggtgtttgcgtaatcgcacaaaaaatcatgccgtgaagccggtctgtcacgacgacctgtgccttacttaactctgtccataaggcagataattcatctaagcgcgtcgttcgatcaactcgtttgccaattgtcgtagtgatcaaaccgacttgatcatacgtctcttgaatatgctgctttagctgccgccgctccttttcagtgagatacgcttccttatcttctcgcaaacaaaggagaaccccttcacgtttttgttccttagacgattcatctaatgtgagcaccatatcaggctgtttccacacatcttgagcagggaagtgctgcttcatccaattgtaggttgtttgatctcttgccatgagaagcagtcttggatggtgtttgtatgtttgaatggcgcggcgttcctctctttttcctctctttgtttctgtaaaatgggcagtggccggcaattgaatcaccggataggacttgaaggttttcataataaattgtctcgtccattcttcataacggtataagtcccccatattgcccccaccgatgatacagacgatgtcttccggatgccgcatacgctttaacggacgggcgaggcgatagatctctttcatgtccacttccatgatgtcataggcgggaaagtgctcttttaaaaaacaataactcgcataggcaatcgcatgatcccctaaattatcatgtcctggcagcagcgtgagaatgattttcttctgatgacttcgctctggcaggctttggcggctcagtcgatattcaagtggatatttcacctttaagagtagccactctgcggcgtgtgccttcaattgctgcaatgtcaatctcatcacccctatttccttgtttgatattcgatccatttttgatagctagaagcggcggcagaaagcggatagaccagccggcacttcgcaaggaataaaatcattcgctttcgagcagtgagcttcgatggttccacttgtttgacggcatgctgaaaagcttcgtgtgtcaccatttcccgcatgtgatcaagcttttcccgaagagagagtgcattttggctcttccattcgttgagcatacaatgaagggtgtgattgacaataaaaaaatcaagtgccttctcatacagagagatgtcatcatattctgtcaaaaacaagcgctgcgcatgataaaaggttagaccatgatgaaaatactgcttttgatatcgctgcacaatagaagacagatgaacccggtagtaataaagtggttcatggacaaaggcaatgccgcgagctaaagaaaaacagcgcagcgtcacatattgatcttctatgttctcaagttctccccgaagcggaaatcgaatgtgatgttcttcaataaaggcacgccgatacagcttattccatgagaaccccgtcatgtctccgtgcaataacgcttcaattaaactcgttttttcggaagaccgctcggctaacagcgtcgttggtatggttcgctttgactgttcaaattgaatccagtactcactgattactagatctgcgccggtcatttcagctttttcatacaaggcttcgcagtaatgaggcgcgagaatatcatctgaatcaataaaggcaatatacgtgccctttgcttcttcgatgccccgattcctcacagcgcctaacccttgattggtttgatgaatgacccgaaagcgctgatcttgctcagcaaatgcttcaagatattctccgctgtgatctgtagatccatcattcacaagaatgacctctatatctgaaaaactttgatctgcaattgattgaaggcattgctccacatattgactcgtattgtagactgcgaccaatagactgatagctggcattacaacatgctccacctttctcaaaatctactttgtaaatatcgtcctgtacggcaacacagatgaatcgaacggcatcagcatgatgctgtacagaatatagcaaacagcaatccctacatagataaagacattagaccgctgatcaaaaatacgtgtgaagtatggcagtaagataagctgatacaagccaaagtaaatatgaaatcttgcataaatgacatcctttgtggcaaggatgccaaacaagaaaccgagcaaacaaaaattcacaacgtaatcactctcaggcgtcagctcacgaagccgttttcgataaaagaacgcgagcaaaagcggcaaaatcaatacaccgatttttgtcacattcattccatttgtattcgttgtgagccattcctcgtaatgtccatatgaactgccttgcagcatcacgacaaacacggaaacaaagcggtcataaagagcggttaaccctaagaaaatcatgcataagagcagcatcatccatgaccacgatcttgttctcacgataaaatacacaggaatcatgatgagagccgatgaatgaaacaatgaacatacgaggacaagcggaaaatacaatttccactgaccattgatcacaagacggatggcataaaaaagaaccgcagccaccatatactgacgcatgccattaaacgaagcgtaataatgaaaggtgccgagaaaaagcagcatactcagctcaaagggacggccatattgaatgagcgtcttgatgataaaaaaataggtgatcgccccaaccgagatatacatgatttgcggatcatgggacaattgattgagcatccataaaataaacgtaaatcccgggtcagtggccgccttgtccacaccaaatccgaagatatgccaaggcttttcataattgatggagaactcatacatctgtccatatgtgacaaaatcggttcctactttgtaccgaataccagcgacaatacaaagaaacaaaaacggaaataacacgagaattttgttaggccgccatccgctttgaatggtatcatcacgcctgccgtaaaatgcggcaaagctcgaccataaatagaccatgatcatgttcaccaaatataccgccatctgccattccttccttacagtccatatccattcatcacacgtgtgatgttctgtttgacatcaaatcctctttgttcaagctgggacgtaatggtctcttgaagaggaggctctgcatgatacgcttcaagcaccaccttcatccattcatgcgcggaatcccgaagcgacattcttttcacaagaccgcaacctaaatctacttcctctgtaatatgatctgaaatcacacaaggcaatccagatgcctgtgcttccactaaaacaagcggaagtccttcaaacaaggaaggcatcacaaatacatcaaatgctttcatatattctggaacgtctgatacgacgcctgtaaagataatgtcgtctaacaagccggccttttccgcatatgattcaaccacctgcttcagcggtccatcccctacaaggacaagctgaaatgagaccccctgcttctttaaggtctgtgccagttccataaaaaaaacgtgatttttttgttcatgaaaacgcccaatatgacctatcaccatgctcttttcatgaagacctagctgctttttgatcttcaccttttcttctggatcaggctgaaagaaaagggataaatcaatcccattcggcagcacctcaacctgtccattcttcatttttttctgaccaaacaaaaaggaaccggcatcctcaccgcatgcaacaagctttgtagaaaatgcaaaaatcagctgacgaaatcctttgagcatcatatggtctacccaatttggcgactgtttccaagcagtattatgcgaatgacaaatgcgcaccttcacacccgccaatttcgcagcaagggcagagaagcctgtttgaaaatctgtatgtgcatgcactgcttgatacggtcctgttcgcttgattgtctttgtcaatgttctgacaaatgccaaaggagaggacgccccaatactcgggacataaaagatacgcccgccgagtctctgaatttcctcatcataatcacagacatccttccggtgggtaataaagtcaaattgaaggacatttctatcgagtgcacgatagatgttcatgatcatcgtttcagctccgccccggttcatcccgcccacaatatgtaggacacgctttggctcactcatcccgaatcgttctccttttcaacaaagacgccgccagcttccgctgatgataaaatttcatgatcttcggtgataaacaggcgcggaccacaggctttagcgcaaacaaataatgaactggcgacaattttaataaccagcatgcttttaaaacgagccaagcattatctatcgagtattgaaacttacggcgctgaaaagccgcttcatcctctctcacaaggtataacggctcttgtaaattaaagccttttctccccgcagcaaaaaaacggatccacagatcgatatcttccatccgcctcgttgttttcacagagcgatatccatttaaagccttgtacgcagcagccctcatcataatggttccatgacaaaaaggcgtccctcttgccagcacttttcgatcaggcgctgaaatcagtgcacgtacacctttagtacccgattcatcaaacacggtcatcgccgtcccgaccacatcatattcaggatgtgattcaaggaaatgcacctgtttttctaaacgatcaggtactgatatatcgtcgccatcctgccttgcaatcaagtctcccctcgcttcagctagacagcgattcagactggcagcgagcctttgattatgctcattgcggataaggcgaattctttcagggtctcgttttgtataggacagcactatttcataggtgccgtctgttgatgcgtcatcacatatgatgagctcccagttgtcatatgtttgatgaagaatggattcaatactttcttctactgtgtcttggcaattgtagacgcccatgatgatagacacctttggcttacgcatgctcacatcaccttctctgcttgatccatataagctgtataaatttcttccatcgcactcaccgtctgctcctgtgcaaatgcatgtgctaaggagcgccctgcttttcccatgaggtacagctgatcccttttgtgataaagctgccgcaaatattcagccaagtcattcacatcatgcggtttgactaaaaaaccattcacgccatgtctgatcagctcacagtgtcctctattctcagttgcaatgaccggcttttccgcagacattgcttcaagcagattcatgccaagcccttctctcaaactagtcgacacacatacatcactcaagtgcatccattcttcaatgtgtttgcaaaaaccagcaaagtggacatgcttttcaagatggagctcatgaaccagcttttcatacatcggccgcatggccccttccccggcaaacacgatcttcacatttggtattttcctatatagctgggcacatgctttaatgagcattccttggtttttattcgcatttaattcgccagcgcacagtacaataaaatcttctgaagaaaagccatggactgcacgaagacgctgcttctctttttcatgaactggtgcaaatcgtttcatatccacacccataccaggaacataataaacagatgcccgttcttttgatagacgatctgctcttttaaaatcttctccattaatggtgatcaaagcgtctgtatggcgggcgagccatcgctcaatcggataatagagcagccagttttgaagcggcgctccttgccaaaagtgaaagccatgtgctgtgtaaagaaccttcgccccttttttgcgcgcgcttttggctgcaagtctgccaattacacttcccattggtgtgtggcaatggatgaagtcatagtgctctttcgctaacagcttctttagctccacatacgcaaaccggttgtgcacatgaaacggagagcgctgaatcggaatcgagtgcgcttgatccacatagggaagctccagctgaccatttgccgctgtatgcacttcccatccttgttcctgaaaccaccggaaatacggaaggtgaaatgccttaaaatgatagtcaaccgttgcgcaaaacaagacttttttcttcatcggcaagcgcttccccctctcttgtcatttgttcagacaacaaatcacgcgattctatggcagcaaacaacgcttctctcatttgctcttcattcatcatgtcaaattcatgaataaagcggttcagcacatatgggtctccatccagcgcatggccgatatgaattttcgggaaaatttgttcctgtgctttttcatgctggttgagtagttcctcatacattttctccccagggcgaatgcctgtgaacgtaatcggaatctggtctgtggtgtaacctgagaggtgaatgaggttttctgcgaggtcaacaattttcactggctcccccatgtctaatacgaaaatctgtcttccttctgccaaggcacccgcctgaatgacaagcctcgatgcttctggaatggtcataaaatatcttgtcatggctgggtgtgtgaccgtgaccggcccgccttgttcaatctgtttcttaaaaattggtatgacgcttcccctgcttccgagtacatttccaaatcgaaccgcgacaaattttgtgccactgcttgcccccatgtgcatgatcaacatttcagcaaatcgttttgtggcgcccatgacattggcaggattgaccgctttgtcagaggaaatgaggacgaatgtttcaatgccatgctcatgtgcagcttctgcgacattttttgtcccgataatattgtttttcactgcttcttttggactgatctccatgagcgggacgtgcttatgtgccgcggcatgataaatcatatccggctgaaactgaccaacgatttcactcattttctgtttatcttggatatccgcaatttgcggatagaggctgatggtgtccccataaatttctttcagctctagtaaaatagaatgaatgctaaattctccatgtcccacaagcacaatcgcttgaggagcaaacacacaaatttgacgacagatttcggacccaatcgatccacctgcccctgtgaccatgatcgttttcccctttaaatggacagatagacggcttgaatctaattgaatcggttctctacctagtaaatcctctggctgtacatctcgtaattgattcagcgcatgggttccttttagaatctgctccatctccggcatgatctgcgttttgaccccagtcgctacgcattccttatacagcccttttaacgtatggctgcttttggacggaatggcgatgatgatcttttgaatatccatcatcacaacagctgtttgaatctgttcttttccccctaaaacaggcagtcccatgatttcaagcttatgtttcctcttgtcatcatctatgaaggcgactggttcaatatgtacatcactcgattgctgaagctgacgaacgatgatggtcccagctgatccggcgccaatgattaaggcccgctccttttctacctgcagccgctttgccccatcatgaaatagccgggatgccattcgagatgcaccgatgaataatacgtgaaaaagccacacgatgaataaaaaacgaaagggccatgtctgcacgaaaaggtacagcattgccattgaaaataaaaaagaacatgcaaaggtcttcattaaagaaaatagctctcttacccctgtataagcccatacttgcttgtacacgtgaaaaatatacgaaaacaaatggtgcccaatgagtagactgagcgaagaaatgacgagcatttcaaatgtataaacagttaacgccgcttcttggacaaattgaaaaccaaaaaagacagccactaagatgagatatgaatctagtgccacgatgattgataatctttgggcgtaagtcaacgctcctccccctttttaaaacatcactattcttacgtaaaatgggcatcaaacccgtcctcacatcccactattgatgacgagcatctaaggcattggtcatgcccacagcaggatcgagtgcctccattgttaaagattaggagacatcacctatcaatcttgttaatacatatacagccttccctttttctctttcttgccatttagcatagccccaagcagtttacctgttgtcccgtctaacacttcttttgatttcttcactgcagctatcttggttttgccgcttaagacaacaagaatgctcccatctgtccggttcgctaggatctttgcatcggctactggcagaagcggcgcagaatcaacaatcaccatgtcatattgctgttcaatttcataaaacagctgcttcatgacagaagaggagagcagctcagctggattcggcggaatggttccgctcggaagcagctctaaatgctcaataggtgtgggtaaaatggcttcctccaagctgcaattatttaatagcacattggtcaagcccgtgtgatggctcaggtcaaaatattcatgaagagccggctttcgcaaatcagcatccatcagcagcacacgctttttctgctgtgcaaaaacagctgctagatttgcagccgtaaatgatttcccttccttcggcaaggaggatgtcaccaatatggatttcagccttgtttggattgatgtgaattcgatgttcgttcggatcgtacggaattgttctgctatgacagagtgaggatttaatacagaaatacaggttaaatctctcttttctcttttctttctcttaaagatcaatgttctgtcctcccgttatgacggactgcttgtctttttttgccctcctgtctgcctgcatctgatagacgctgccgagcgacggcaatccgatctcttctcttatttgatgtgttcgttttacagtatcatcgagtaggttcattaagaaaatgagtgttatcccccctaataaagaggcgcctagtgccagtacgatatgaacgaattttcttgaattcatgagaatcgtattggacagcttggcttcagacaaaacattaatgcgatccatattcatggtttttttgatttcttcttgcagcacctctgttgcagtatttgcgatggcgactgcctttgcgcgatcctcatcttgtacagaaatattaatgacctcagactcattttctgtacttgtggcaattttgtgttttaatccttcagctgattctgtgaggttgagtgtttcttttactttttcaatgacgattggactttttaataaaacttgaaaggtacgtgtatattgaaggttcatctgaatatcgtttaagtttgcttgtgcgtcattgctgcgtttatgaacaagaatttgagtggttgcctgatatacaggagtcgagacatagaactgatagtaggctgaaatgcccgttacgatcaggacaatcaggatcagaagggccattttctctttaatgacagaaaacagctgcttaaaacctatattctcattcatagatacctcccgatttcatcataaaaaggttatatatggtttctttttgttaatgattggattataaaagataatacccgcaaagaaaaatgtcataataggtcttatagttctttttaaagaacaaaatcgttcgttttcttttgtttacttcctgattcttacgtttttgaattttataaagaacaatttatttcttataatgaacgaaaaggtcgcactacgattcgccagggagaagggagatcattgatcgaatgataggaaaggtgatacgcatttaccgaaagaggaaaggatactccattcagcagctggctgaagatgcccatgtttctaaatcttatttgagtaagattgagcgtggtgtccacagaaatccatctgtccagtttttaaaaaaggtatcctcttcgctagagattgatttacaagagctatttgatgcagagacgttgatgtttcatgagtctgagagtggtgaacatgaatggcgggagcatatcgtcaatgccgttcaatccggtatgccaaaagaagaactctatcagctgctccaaacgtatcgaaaagagcaggaagaaaggacgttacatgtcactcatagaaggttgacggattcaaatatatcagagtggaagcgtctgatgagtgaagcgaaggccatcggcttaagcattgaggaagtaaaagcattcctcgccaacatgggagaacgacgggcgtaagcctttcaggaagagtcaaattgcggggagaggcgtttgacgcttcgctgaaaaagagccttttatcatgaaaaggctcttttttctcttattctgcttttttcgttcgtgcttttttcgttatatcattgtttttccaataggcccagagagatgtaatcccaagaaaggctaacgtgatgaattgctgaataccttcttcatcaataggtattgggctttttcccgcagcggttagcgcactgttgacaagtgcgagcaaaagcagcacaaaccttgcaattgtacctgcactaattttttgaacctccaactgtaacccctccctttcttccccttcacgggcggtacggctcgttctctctcatatgtatgcaaaagccgaaagaatagaagaccggatcaaaaaaagagacatcatacctatataaggaatgatgcctgatttcatcttattttgatgttgaaaacatctctttcgcttcatccaatgccattttattgcctagtgctgagtaatcgagccatggctgatcggcaatcggataaacttggttgttcttcacggcttttagacccttccaaatcggcgtcttttctaattgcttgaatgcttgctgggctttatcatcacggttcacgacaacaaagatagcatctgcatcatagtcaggaagaacctcttgagaaatcacttcaaatggccgcttgctgtccagtttcttcacaccatcgacaggtgtgaggcctaaatcctcatacaaaattggacccattgggcgcttcatgctaaatactcgaagctcctttgccgtcacacggatcgccattacttttccgtttccaatcttttgcttgatgagcgatttgacttcttttgcttcttgattgtaatcctgaatatattgatcggcttctttctctttattgacgagcttgccgatttttttcaaatgatcgcgccaagtgccgttatttaaattaaacacttctgttttggcaatttttttatatttcgataagtcttgtccagctagttcttcatcaatgtaaataacatctggttgtaatgcaagcagcgactccatatcgggatcggctgcgatgcccagcttcttcgtaccactcaactgctttttcgcatgcggaaggaaatcttttaaatcccctcctacaacagagcctgccggcttgatgccgagagctaataggtcattcgttaaatgaatagacaaggaagcaattttcggtgttccatgatcattttgagttgctttattctttgtttcctgttgaccacaagcggcaagcaagataaaacagagtgttaaaccaagcacaagtaattttttcatgatgagttcctctttcttgttttatttcgtttttactaataaatagagaaaataaggagcgccgataaaagccacaacgacacccgctggaatggcatttggggcaaagatggaacgtccgattgtatcggcactgaccaaaatcaacaagccaatcagcgcactaactggtaaaaaatattgatggagtgagccgacaagccgccttgccaaatgcggggcgacaagtccaataaaaccaataccgcctgtcattgaaacacttgcactcgccaaaccaacagctaaggtcagtaaaaggagacgctgacgctggacacgaacacctacacttgaggcgacagcatctcctaatgtcaacgcattgagcgtgcttgactgcatcagcgtaaacggcacaaggcatacaatccaaggcagaagcgctaacacatgaatccagtctctcccccagacattgccgacaagccatcttgaagcaaatgtgtaagtatcttcatccagcttcaatgacaaaaataacgtcaaagcactgaatcccgctgcaactgcaattcctactaggatcagccggatgggaacgagcccttcctgccggtcatacgccagaagcacgatgaccgctgccgcaagaagccctccgccaaatgtaaagagcggaataagaagagagggattgccttctagagcgtggaaatacgttacaaacacgattaagccaaatgcggcgcctgcattcagtccaataatccctggatcagccagcgggtttcgagatagactttgcaaaatgcctcccgcaataccaagcccaattcccgctagcatcgttaccacgattcgaggcagacgatagtcaaacagcacggtttcactttgaaaatctccaaagccgaataacgttttgacgaccacaagaggatttagtttcagcgtaccggtatttaagctataaagcacaacagccacacttaaacaaagcaaaatgaccgtcacaacaagagcccgctgtttctctctcatgacaggttcctcccttcttttctggcaatatacaagaagaaaggaacaccgacaagtgccaccatcacgccaatggcaagctctcgcggtggattaacggtgcggctggcaaggtcagcaaagacaagcagcaccgcgcctaatatcgctgacatcggaatgacgaaacgatagtttacaccaaccagctttcgtgcgatatgcgggataacaagaccgacaaacccaatggagccgactgctgacacagaaacccctgctaataatacagcagctgccattcctagtattcgcacttgtcgcgttttcacccctaaatttgccgctacatcttcaccaagcgacagtagcgacagtgaccgtcctaatagcatcgcccagacgatcactatgagaatgaccggagcaagaattgtcagctgcggccatttcacaccagccactccgcctgcataccaaaacgcaaggtcctgacttaagtcaaaataaatcgcgattccagagctaagtgcatgaagcaatgcagccacaacggcccctgctacagttaagcgcagcggtgtcaaaacgccgccagccgcaccaatcgcaaagatcagcagcgtactgagcactgcaccaataaaggaaaacaacatcagtgccgaataagggatgcctgggaaaaaagcaaaacagagagcgaccacgaacatcgcaccgccattgatgcccaaaatccccgcatcggccagagggtttcttgtgatcccctgcatgagcgcacccgctacggcaaatgccgctccaacaagagccgctcctaaaacacgtggaagtctcaattcatggatgatctgctgctctgtgacatctggctgatagtcaaatacagctgtccaaaccgtttgcagagacaatgttttggcaccatatgacacagccaaaaacatggcagccgccaaaccaatgacggcgagaaaaaatatcaaaaagaacaaaatatatgatgatcgtttttgttgaggtgttcgcttatcctgcaaaatcggtgtcatccttttcttcattaaaagtctgtttgaaaatgagaatcataatcatcaaaattatatctgcctgcctctcaaaaatcaatgtacgccttattttttaattaatgaaggtattcagatgaccgtgtcatacagtgtgtttgctcgtttgaaacggcctatcactttttctcatagtttaataggaaaatagttgacattccgcctgaatatcctctaaaattacaaaagtaagtcaaatgttataaaaatattacaaacagatgtcaaaccgataaagaatggcccgtcttgagaggagatttgaacgttgtgtcactaaagggaaaatggagtatcggcctatttgcacttgcgatcgtcattggaatcgtcgctttctttcagaatcaacaagcaagtgggaccgagaagaaaaatgtaaagcaggatacgaactataaaaacgtcgaaatcgttactctcgtaaatgacgggaaatttatgagatatgcagtcaactatcctctttttcatcaaaaagagctagatgacaagattcaaagctacgccaattcagctttagagcatttcaaaaagacgtttagtgaagccaaagacgtcgatgaaaacaaacgctttgaactgaatattgattatgatatggtgcattatgcgaagcagtctgctgcgattcgctttacgacttatacctatacaggtcagcaaaatgggaccaccaatcatctcacgatcaactatgattttcagaaaaaaacctttcttgacacaaaagatttatttctgcctaaaaccaactttttgaagaaattatcctacattacatattcggagcttcaaaaggacaaaacgttatctaaggatcagacgctccttcagaaaggaactgcccctactgctcaaaacttcagtcaatttgccttgaaagagaaatatgtagaattttatttcccagcatctcaagtagccggcgaagatcttggtccgcaaacactcgcaattaaaaagacgctgctaaaagatatattgaagccagaatatatgaataaaaccaaaaatcaaaatgaaatgaaagaaccaaatccgaaaagaaaagccgtcaagctgccgcaaaaatcaaagcttgatccaaataaaaaagccattgcccttacatttgatgatggtccgaacccagcgaccacctcaaaaattttagaagcactgaaggaaaataaaggacatgcgacctttttcgtattaggcagcagggtgcagtattatcctagtatgcttgccgatattctaaaaggcgggaatgaaatcggaaaccattcttacagtcatcctttattaacaagactgcctttaaaggaggcggtaaaacaagtgaaggacactcagaagctgattgagaaagcgagcgggtatttacctacgcactttagaccgccatatggtggaacaaatcaagacatcaatcaagcggttgagatgaaggtctctttatgggatgttgatcctgaggattggaaaattcgcaacagccagcagatcacaaaccacgttctctcacatgcagcagatggcagaacggtgttgatgcacgatatttatgacagctcagctcaagcagcagtgaagatcattcaagaactcaccaaacaaggctatcagctcgtcacggtcagtgaacttgatcaattaaaaaaagaacggaatgaacaagcccctgtgcaataacacaggggtgttctttatgactccaaagatttcttttgtttcaataatgcttgaaatgtctcctccagctcctgagacggctcaatacttaaccggctgagcacttcagacagctgtaaatcaattaacagcagctcctcttctctttgggtaacagctggtttgtcgtctttttgtttatacgcttcatatgtcccatcaaatgcttcaatacgcttttcatgaacatgaaaaatgcgagtcgccaccttctcaaccagtctgcgatcatgggaaacgaacacaacagtaccagggtaatcctttaatagaccttcaagcgcttcaactgccgccagatctagaaagttcgtcggttcatccagcatgaggacattggcatcgctgacaagcaaggacgccagcatggtcttcacccgttctcccccgcttaataccccaacaggtttatgcacgtcatctcctcgaaatccaagtctcgctaaaaccgttcgtactactgtctcatcttgaactgcctctttcagcgcattttgtaaaatcgattcatctacctttaatcctgaaagatcctgacgaaaatagccgagcttgacagcttctgagcgagaaactccgggatgtccattcaccagcattcggagaaatgtcgtttttccgctcccattcttgccaatgatggcgaccttgtccccgcctctcacttccacattcgcctgtttccaaagcaattgatcgcccgccttgccatctacatttttcactcgcaaaatggtacggctcgctacttctttcattgaatgctgcgtcatttgaatgggctgaatgtcttttactttctcaaccttttctaatttctccattcttgtttcaatcgatttggctgttttttgcagctttttttgcttatttgcatagtagggctttgcaatttttggccctgaggatttcagcttttgggatggctttgtcgctttgtcggcttttttctttttcttttccagcgcatgctctaactgttttttcttttgggtataagcttcgtacgcttccacctgttgacgatgcgctaactctttttgctgtgcaaactgcgtgtagttgcctttgtattgattgagccgtccatgatccagctcccaaatctccgtacataccgcatctaaaaaagcacgatcatgtgaaacgacaataagggctccttgataattgttcaacttctcttccagccactcaatgtgctctgtatctaaatgagtcgttggttcatctgctaacaaaagggcagaaggacggtttaacgcgctttcaatataagactgggtcatctcaccaccactctgtgtgccatccgcttgttttaactgaggaagcagtgtgcaggtcgttgtagcagcaaacgtgccactgtctggtgtctcttgccccgtgagcacgtgtaataatgtcgttttcccgcttccatttgccccgacaagtccaatgcggtcactttgatggatggtcagttcctcaatatcaaataacaatcgatcttttcgaaacatctttaactgattggcttttactaacatccaaccctctcctttcgtatcaggagacatgaaaaagcctcccattctcagaataggaggcaaaatggtgtacaaaaataagcggatcaattccggatgacgtgccgttcctatctgaacacacacatcccccgtatcaatctcctcattctttgattcccaagctgtaccatcctattccgaagctaaaaaatgaaaacgcagcaaacatggcaaaccaatcgtttgctcactgccttcgttttttcattttgcttacaggtcataggattagtacttcattgcattgggtcacccttccgtcgtttgttacgtttacaataaaagattggttattttttgtcaagctgatatggcataagtgagtccattaatttcagcgtaaatggatggaccgcatcaagcagttcatcctttttgcattcttccactatgcttccttcatgtaaaaataggagacgatcacataaatacactgccgcttctatatcatgagtaatcataatgatggtcatgtctagctcttgttttaatgtctcgagcagctccaatatttgcacctgaacagagacatctagtgagctcaggacttcgtctagtatgagaatggatggatgcgttgatatggctcgcgcgatgcacactcgctggagctgaccgccgcttagctgatgagcatactgatttagtaaagaagagggtagtctgacttgttcaagcaacaataaaatcttctgatccacatttttttcctgctttaacaatcgcataggctcagcaacgatctctttcaccgtaaaggaagggtgaactgaagatcgataatcctgaaagacaacactcattttccctcgattcaccttccgccatgtgtcagctgacttcccctcaatctgcaccttgccgccatctattttttctaaaccgagcaggattcgtgccaatgtacttttaccgctgccgctttcaccgaccaaccctgcacattgtcctttttcgatttgaaacgagacgtttgatatgcgtggttttgactgcatttgccgagaaaagaaacctttcttctctccatatttaatgaggctatcagctgtgatcagcatggaaatgccctcactctctgctgctgccgcagcgtttcaaggggctcagataatcggtgcctcgtctcaagtaaatgcttcgtttggggatgctcaggcgctgtgaataccttctcagctgggcgatgctcaagcatctccccttgatgcatcaccaacacctcgtcagcaatcgcctgaacgacgcctaaatcatgcgaaatgatgatcaaggctgcaccggtttcttctttcagcctctgtaattgcatgatgacttcacgccgattatatgcatcaagcgaagcagttggctcatcggcaataatcacatcaggagaaagcatcatcgtgatcgcaatcatcactcgctgaagcataccgccagataattcataaggatattgcttcaacaattcttttggattttttaaatgaactcgctccagtcccgcgatggcaagtgctttcccttcttttccgtgtaagcccaaatgccgttggaacgtttccatcatttgatgaccaatggtttcaatgggattgaacgcattcatcgcatcctgtgagatgaagccaattcgcttgccacgccactgctcagctgcctgtgttgtcaatgtttcgccgtcaaatagaatcgctccctccacttctagcgaaggtggaatcaagccaattaacgctgttgcgacggttgattttccgcttccactttctccaatcacagctaaacagagttgttgctgtagggagaacgtcatgttcgccacgatactcttttgttgaactggatcatgtacggataggttttttacgtcgatgaaaggcaaatggtctcgctcccttcttattgtgatgatacatcgcaggggtcgtagcctgctgcaggctgtctcctaaaaagttcagcgccatgaccacaaataagatggcaagtccagggacaagcatatgggctggatgggtcaccatgacatttttcgcttcgttgagcatcatcccccattccggggtaggtgcgctcacacctaatccaagaaaagacagagcagatatatttaaaatgacccagcccgcatcaagtgtagcaaagacagcaatttctcctgaaatgcgcgggaataaatgcttcctcaggatgtaaaatggggcgccgccagacacttttgcaaactgaacagatggttcattcgcatattgcagaacggacgaacgaatcatccttgtataccaagcccatttcgctaggacatttgccaaaataatattgaacagtccaggccccagtatcccgacaaccgctagaatcatcacttctgccgggaaggagagcatgacatcacacagtctcatcaacaagccgtccgcttttcctcgaaaaaagcctgccatgagtccaagtgtgctgccaatgagcatcgttatgcacatcgtcagtatcgccgcaagcattgtggtgcgaatcccatataaaagtcgtgacaatacgcacctcccgagctgatccgttccgagcggataagtcaggctgatgccggcatatttttgaagaatgttcgtttctgttggatcatgtggtgcgaacactggtgccagcagccctgctaaagcgacaagtactaacagccagatagaaagaacagccatacggtctttttttaattgttgccaacctatcacccgtctcacgcctcctttcgcagctgaagattcatggtcatttgcacaacatcagcgatgaggttacacacaacaaaaaggaaccccatcacaaataaataggcttgtataatgggaaaatcagcgtgaaaaatagctgttacacacaaccggccaacccctggccaagcaaaaagattttcaataataaccgtgcctgcaataagctttggaatagacataccaagtgctgtcaccgctaattgaagcgcatgtctcatcactttcaattgaacagcgcgttcctttaacccgcgagctcttgcataaaaaacaaagggctcgtgctgaaatttcaggatctgattgcggatcagtctcacataggtggataaatagccaagtgatagtgtgacagctgggagaagaatcgatttgaacccatccataccactcgtattaacccaattgaatttgacagaaaaaagccaaataaacaaaatccctaaccaaaaactaggcattgaagcagcgataaacacaaaggctcgcagtactcggtccacccaggtatgcgcagcatatgcacagaccactccgaataacaaactcagcacaatgatgaaaaagagcgctgctcctgcaagctgcaatgtggcaggcagcgcctccataataagatcaaaaaccggctcctgtgtaacatagctcctgccaaaatcacctgttaaactagctttaagccatgtagcatatcgtataagaaatggctgatctaagcctagctcctgccgcatcgattcaatcatgtcttctgttggagtgacttgattcacccgcaaagcgacttcagctggatcacttgcccgcatcgtcagcaggacaaaggcaaagaaggtgatgaacatcataagcgggataagcagcaatattcgttttaagagatagcgtgtcatgtctccgccccctctttatgacgaaaaatacatacggtcaaagggaatttcatactgtgacacatgaaaaccaatacctttcaggcgcttattataaacggcctttgtcacagaataagagattgggatgtagacattttcatcatgaatatacgtcaagatgtctcgatacatttgtttccgcttttgctcatctggttctaccaatactttcgtaatcgtctcatccagccactttttcttcttcaaccctaattgggcttggtaatcagcatgcgatgctacgcggaacgaagaaacataggtttgaggatcataaggaagtccccacgacagtgagtacatcaggtcgaatttccctgttttttggcgatctaaaaatgcctgtttttcttctcctctaatatccagcttgactccaacctgcttgaaatcttgttgaatcgattcacttatcgttctttcgcctgcattatcggaattatagtaaatggcgacactcagccttttgccattttgatagcggtagccgtcttctttcagcttccagcctgcctcatccagtaatgcttctgctttctctttttgataggttttccttttcagcgggatatctgcgtaagggactgacggggcaagcagcgtatgtgccacctgttccgttccatttaaaatgccttttgtaatcatttctttttgaatggcatattgaaacgcttctctgactttcggatcttttgtcattggctggtttgaattgatgacgatcgaccttgaaccaacaggtggactcacggtcacaccgtattgacctgcctcctttaaagcctgaaatgagtctccgtcgatcatgtcaccatctgctccaaataagagatctatttctcctttttgcagggcaagtaaaatcgtttgatgatccggcatgactttccatttcactgtcgaaatgtttggctttttcccccagtactgatcattcgctttaaaaacggcatattgattttttttatgttcctttagcacataaggacctgtgcctgcatagctttgtactccttttgcagtcgttccatcaatgaagctttttggagaaataaaacggaagggacgtgttaagcccagttcttctaacgtaggataataaggctcttttaacgtgagaacaaatgtatcatcatccactgcctttgtggatttgatttcagatacgagattaagccaagcattcttttcaatatttttaacgacagcatccacgttcattttcactgcctttgcattaaaaggctcgccatctgaaaaagttacgccttttcgaaggtgaaaggtgtaggtccttccatcctttgaaatgtcccagctttttgctaaggcaggctgaacacctttctctgtattgacgacaagtgattcaaacgccatattttgagcggccatctctccgctatataaatgaggattgatatcccttatatcttttgtacttgcatacaccagctcatcttcttctctgtcattcatgctggaagatgctttattttcagagcatgaggctaataaaaaacaagccatgactgaaaacagcatcaaggtgtatgtcacataggattgctttttctttatgtaaacaggctgatcactcatatgtacgtccccccaattttatattatcgtaatcattacgattattaatcgaaatgattacgaattgaataatagcatacagaactggggaatacaatcacttttttcatcaaaaaaacagactcatgattgagtctgttagattgttgacaaagggctaaaatgatcttgattttagccctttgtcttcttttcagcgtgatagaaaacctttgaagtctaggaaggacgagcactggcgcggagcgaatttgacattcgtgagcaccagcgcgcaggactgacaccaaatgcgagggtttgcctacacgctgacagactcatgattgagtctgtttcgtcttcatccattgatcaatcgaccgcaatgctttatcggttccacctgctgtttggaagctttcttcaattttttcgattccagcacggtacgtattactttccagaacagattccacggtttctcttagctgctttgctgtcagttgatctttatcaagtgcacgggcagcagatagctcggtcagtctttgtgcgaccatcggctgatctttgtcgatcggaatgacgaccatcggaacgtgataatgaatgccttcattgacactgttcattccgccatgcgtcacaaacacatctgtcagctcaagcacttcaagctgcggcacataaggctcgatcagaaaatgagaaggtgcttctttcaagagagatcgatctactttttcacctgttgcgagcaccacttttccatcaaaatcggcaaaggcatcaatacacatattaaaaaatgcttctgtatccccaagaacggtgcccatcgaaataaagacgactttttcttgctcaagtgcttccagcgggaaatcatgctgatctgccctttttagaaagctcggtccaatgaaaacaaatgagtcgtttactgcatcaacagacggctgaaaatattcacttgtatacacgatattcagttctccgcgatttttcatgaattgcatcaaacgcgttggctgaacgccaaagcgctcttgtatgctttctaacagatgatcggctttctcatcctttctgtatagtggtgtatcaaaatgcgcctcttgtagcacaaaagatgggtttgaaccgatccctggaatttgtaagtaatctcgaacaagctctcctgccccaaacatatcaaaatagacaaaatcaaatgaatgctgctgagaaagtgtttccaccacctctaaaatatcaaatgatgtttgtagcatggcatgaaagaacggctgcatggaattgagatttccttcatccacatgtaatgtccgaatatagtctggatgtttatgtacgtgagcgcctaagcgtttgattcgttcctcataatgtacagttgtgaccgcatgcacttcatctccacgatccgcccaagctttgataatccctaacataggattcacatgcccttcagcaggaaatgtaatcaataaaatcttcgccacaagaaacccctcctcattgtcaattctcttccatgttaatcatatacagccagcaggctcaacaaatacgcctgtaaagggaagaaatgagtcttatggctagtaatttaagaggttaacagaaaaaataacaaagcatgcagttatgtgctttgttattttttaagtagtatttctttaaattctgcagattgcctttccatagtaatcggattgcatagataaattcacatccattgatttaatagtaaagaacctgttcttgttttactgctttatttttctttgatactaccctatattgtgataccaaggtctttattaactttaaaggttctgagacatctattgtcatagaacctttaacttaatactttaggatttattcaaagcacgctgaatacacatttcctatattgaaaaattcaagcagtgctctttttgcttcagggctagcttttttcgcggctttatttactgctatttttactgcgttccgcttactctttccagactgtctggcggctttataagctggaatcaatgttttaacaaattttgttgcgcctcctgcagcttttatggctgacttaacttttgcgatttttgctatcggtataacattggttataatggctgttccaaccgcagatatacaccccactacacccaaagttacaatttcactatgtcgttgaacagggatatttgagttctcttgcaaccatttaacgaccgctccatctccttccgcaataacgctgtcaggtaaagcttcaatcgccaataaaacttctagcaactcttgatactcttcatccacctctgaactaggactaattgctgttgaatttgctgtgaaaatcgttgaaaataacagaaaaagagctgttattaagcatatagcgcccttctttcgaaaaacaacttgcatccaatatacccctttcttgtttatttttgcatacgcggtaaaaatatcatattatactaattgtttcaatttatagattcatattggagggatattttgtgaaagttttagagaaatacagttatttaatcatcattctttgcttattagcaatggtagtgacaaacttcaccgtagatgataatacaataaaaaatagtgtatcaattataggatttatcattgttcttcttacaattatacctgtggctatttacaagaagaatcaaaaaaggtaggtatgcccgctttattcttcagtagatggagacaactgcgagtatggattgaattaattttctattcaaaaacaagcaataaacccctctcttaaagtaaaaaggggtttatttttattataatcgagttgattctgttgactctactattccagtatctactcgatttaacaccttgataactcgtagataacagcagcccattccttctaattttcccaataaaaattcactctttagtgaccagtaatgaaaaaagaaccttttagggtgctttgtaaccgcaagtgttctctattcgcgttttgcactttcattctctttctgctcaaatatcattagcaatgatcaacatgatcatttttcacttacttaccctatccttattggaagtgaacgataaattacgattgaacacaaaaaccccctctccatctgaagagggggttttaaaggacctttatcaatcttagacaaggtcaagtacgcgctcggagggattcgaacccccggcagacgtggtaccggaaaccaccgctctatccaactgagctacgagcgcatgatatgtttttgaacgtcagcatatcaaattataagggaaatgctgcaagaaagcaatgatattctgatgacttcaaagaagaagcctgcaccgaaaagatgcagacatgtctacttatgcacttttaacagatgcaataatttttcgttccatgttttcatttacttcatccactgttttgacaagacaaataatcccatcaataaatggccaaatgaacaatgtcaaccatcctagtagaagcatggtcactgcatagcctttcttttcatcaagataaaaacgatgaacggcaatcgctccaaggaaccaccacaaaataaatacaactaatttcgacttttttttggcttgaagttcagttgatacaacaatacgctgttgatcagtcaaactacttttctccaaaagattatccactctttttccttctttctgactatatataataataacataggtaatattacctcataacagaaagttttaccatattttcttaaaacttttttatggtttaagaaaataaatttttgggaaaaataacatgtgcctgtcgaattttttgattgcgttttgtttgacctttattgaccaaaaatgtatcattgaattacatacttacctaaaaggtgaaggaggaacattatgaatttaatacctacagtcattgagcaaacaaatcgtggggaaagagcttacgacatttattctcgtcttttaaaagaccgtattatcatgcttggttctgcgatcgatgacaatgttgccaactccatcgtgtcacagctgcttttcttagaagctgaagatccagaaaaagatatttctatctacattaacagccctggcggttcaattacagctggtatggccatttacgatacgatgcaatttattaaaccaaaggtatcaaccatttgtattggtatggctgcatctatgggtgcgttcctgcttgctgctggtgaaaaaggtaagcgttatgcccttccaaacagtgaagtcatgattcaccaaccactaggtggtgcccaaggtcaagcaacagaaattgaaattgcggcaaaacgaatcctttctttacgtgataaactgaaccaagtacttgctgaacgtactggtcagccaattgaagtcattgaacgcgatacagatcgtgacaacttcaaaacagcggaagaagcacttcaatacggactcattgacaaagtcttgacccgtaattcagaagaacaaaaataatatgacaaaacaaaccgtctgctccttgaacagacggttttttgtgttgaaaacacgctttacgacagctccgtccatttctgctgaagagttggtgttcgataagaagacatctgcgtgattaattcctccggttcgctggaggcatgtaacaattggagatgtgattcattcgaaaaaccttcctgtatactaaacttcaccatgtctatgagcggattgaaatagtcattcacttgatataagccgattggcttttggtgaataccgatttgtgcccagcatagcacctcaaataattcttcatatgtaccaaagccgcctggcatcgcaataaatccatcagccagctcactcattttcgcctttcgttcatgcattcctgttacttcgattaactctgtcagctcttgatgcacaacttctcctctaaaaagccctttaggcataaccccaatgacttgcccgccatgtcttaagacctcatctgcaatggcacccatcaatccaattcgtgaaccgccatatacaagacggatgtcttgctctgccatataagttcccagctctacagccttttctttgtagacgtccttcacgcctggattcgaaccagcaaacacacaaatcgttttcatcaaaacagctccatctctctctatgattacttcacccactcattctactataattttttaaaaaaaacagccgcttcatctatatatagtgtaaaatcaaaaggtgcacaccatataaggagctgtataaagagaatgcaaacaaatgagatggagaaatggatcaaggatttttacaaaaagagaaattggacagaatacggaccgtttatccgattagggttcctgatggaagaaacaggcgaactcgctcgcgctgttagagccatcgaaatcggacgtgaccggcctgacgagcaaaaacaaaactcagctgagttgaagaaagaactcgttgaagaaatgggagatgtattaggaaatctactcattttagccgatctctatgatgtcacagtagaagagattttctcctctcatcaacagaaactcacaaagcgtttttcagaactgaaaagcacgtgaccacatcgtcacgtgcttttttccacttttatagatgctgtggtgaaatatcatctgttcgttcaaagaaatgctgttttccaatatgatggaaaagacctgtccgacgcaaaagctctttcggctgtgattgaagtccgacaatcatcagcttaccattatggtgctttaaccgattggagatattcatcagcaccgcttctgctgatgtgtccatgtaattaactttattcatgagcagaatgagcgttttcggctttgtctgaacatggtccagaatcgagttttcgagtgaatctgttgttccgaaaaacaacggcccttcaatggcgtacatactgatgccttgctggtctgtctgtttttctaaagcagctgctgtttccatttggggaaccgcaatgtttggatgaatgctcgttgtctggctcattttcttgataaaagcgataaaggctaaaatgagcccagcggtgacgccaataatcaaatcaccgatgaccgtcagcaggaaggtcacaacaagtacaagtgaatccgcatttttcacttttacaatattgataaactcttttttctcactcatattccaagccacaaacatcaaaatcggtgccatcgcagcaagtggaatcatcgacgcatatggtgcaaacagcattaagatgagcaagacgacgacaccatgcacgacacctgaaatcgggcttactccaccatttttaatatttgttgccgtacgggcaatcgccccagtcgccggaattcctccgaacagcggtgccgccatattggcaattccttgcccgacaagctccttattgctgtcatgctttgagcctttcatattgtctgcgaccattgcggataaaattgattccacaccgcctaaaagcgcaatgacaatcgctggagggaggaggtatatcattttttcaatcgttacttcaggaaaagcaaagcttggcagctgacgaggaatttccccatatgccgagccgatcgtttcaacttgtccttgaaaaaagagaacagctagaaacgttgaagccaatagacctaatagagcaccaggtattttaggaatgtatttttgtgccgccaaaatcacaataagcccaatcacagctgtaatgatggcaagactgtttgtggtaccgagatggaccacaatttctctcatattgaggaaaaagctttcatgcttttcaacaccctttaatccgaggaagttggcaatctgccctgaaaaaataatgacagcaatgccagcagtaaagccgatgataaccggacgaggaataaatttcatgagctttcctagcttgaatatcccgaataatacaagcatacaccctgccataaaaccggcaatgagtaagttttcgataccgtattggctgacgataccaaataaaatcggaacaaacgccccagtcggcccgccgatctgatactttgaaccaccaaacaatgaaatcaaaatgccggcaacgatgactgtgtataatccatattctggtccgacaccagatgcaatggcaaaagccatgcctaaaggaattgccacaacgcccacgacaagcccagcgattaaatcacgtctaaactttgatgaatcatatccttcaaatcttccataaaaacgcatggtatgtgttggcctccttcaagtatgtgtagatgatttaggtatactgcgcgtcaatctgtttatctttcacaacgacatccagttttcccgttgctggatgaatgacaagtccatgaacagacacatcacttggcatcaatggatgctctttgaccaatttcacactttgagacacgctctcttcaaccgaatcaaagcctgtcagccatccctttaaatcaactcctgagtttttcacgatgctcaaacatttctcttcaatgccgcgtgctttcgccttttcaagtaaaggctctgccgcaagacctgccattccgcattcatgatgtcctacaatgcatacctcttctgcctttagctcatagatagctaatagaatactcctcatcacactgccaaaaggatgtgtgacgatggcgcccgcatttttaatgatctttgcatcaccgttgcgcagccccatggattgcggcaataattccaaaagacgtgtatccatacaagttaatataacgagtttcttttcaggaaatttccccgctttgtaaggctcataatgtctctcatgtacgaactctgaattgtgctgaagaatctgttctaattttgatcgcatcttgccatctcccatctttttataaatcacgtaagctactgcccgtcctccttttctttcgtgtgttctcaagcataaagatgaaaaatgatagaaaaaaaagaaaaaaatgagaaaacgatgagaagaaatggtatcattttctctcatttacgcttcatcgcaagggggacgcggtcctcctttcaatctatcgttctctgctcggcaaaagacgatgaaatggtttagtagaaaatgaccttcccgtttaatatgtttcaaatataatcatttttctatcaaaaaatctcgatcttttttccagtttgtcagataatctctcagaaaaaccggctttttcatatgtcacatctcccattagctgatttccatctaagtaaaaaatgcatcagatggcatatgaataacctttttcactaagaaaatgtctctcttttcagttattttagtatattaaatattgagcagataaccttcagacgtgtttagcctaaatagttgctttataataaaaggagcaagatgatcatgtgagaggagcgagttgacagtgaaaccacacatttttgtcgccaaaccattacctgcctcatttgaggaaatactaaaggaacattgtacatacgaggtgtggcaatcaaaagaccccattccaaaaaatattttatttcaaaaactgcagcatgctgatggtcttttaacgtctgggacgaaaatcgatcaagagctattagatcatgcaccaaaactcaaagtagtgagcaacaactccgttggctatgacaacttcgatatagaagtgatgaggcaaagaggcgtaattggaacacacacgcctcatacactcgaccatactgtggctgaccttgcattttcactcattctttcctctgcgcgaagaattgccgagcttgatcgttttatccgtgaggggaaatggacgaaatttgtacaggaagaggatatctttggcatcgatgtccatcatcaaacgcttggcattattggcatgggacgaatcggagagcaagtcgccaaacgagcttcacatggttttgatatgaatgtcctgtaccataaccgcagccggaatgaaaaggctgaatcagcatatggcgctttatattgcacacttgatgacctgctaaagcaagctgatatcattgtgttgattacaccgctgaccgatgaaacgtatcatatgattggtgaacgagaattgaagttaatgaagcaatcggctttattcgtaaacatctcccgtgggaaaacagtggacgaaaaaagcctctttcaagcgcttcaagagggatggatcaaaggcgcaggtcttgatgtatttgaacaggaaccgcttcaggagaatcatcctttcaaagaaatgaacaatgtcacccttgttcctcacatcggttccgctactgaaacaacgcgggatcttatgctgaaacgagccattcataatgtgattcatggaattgatggcaaagctcctgtagatattgtaaaagagcttgcttcatcttaatcggcaaagacgcaggattcagagctgcgtctttttatttatttcatctgaagggtatcaggagaaaagcctcattttagcaaagatcctgtttctttacatttccttcatgttcgggtgctataatatgaggtagacaagcatcaagaggacagcttccgatttccttaataggaggatgaagatgaaaaaaatcagttcggtttttactatgtttgctctgatcgctgctattctgttttctggttttattccgcagcaagcctatgctgaaacaccacttacaccgaccgccacaaatgaaacagcttctattcaactgacatcagatgttcatacccttgccgtcattaatacgtttgatggtgtagcagattatttgattcgctacaaacgacttcccgataactacatcacaaaatcacaagcaagtgcgcttggatgggtagcatcaaagggaaatctagcagaggttgccccaggcaaaagcatcggtggagatatattttctaaccgggagggacgtcttccttcagcaagcggcagaacatggcgcgaggccgatatcaactacgtctcaggcttccgcaatgctgaccgcctcgtgtattcaagcgactggctcatttataaaacaacagaccattacgcgacattcacgcgtattagatgatcaatcaaaaaagacagcccaattcgatgagctgtcttttttatgatatttgcttgcagactggattgagagttcgtttcaaaacaaattgatcatgatcaacgaaatatatcgctataaccttcgtattcgtgttattttcaacataaaataaacagaatattatgttaattattcctttaaatcaattagttttaatattttatatcgtttattttgttcacctttagttgttcatcttcaatcatattttcacttcgtgcaatacagagtgtacttactacgtcacctgtaacgttaagtgaggtgtgccccatatcgatgattctatatatcccagcaatcattccaactatctccatagggagtcccaatgtagttaacagcataatcgtcataacaataccgcctccaggaatgccgggcgatccaactgatattaaagttgtcattaatatgactagtaattgctggctaattggcatttcaattccatatatttgggatacaaatatgatggcgccagagtaataaacaacggcaccattcatattcatcgttgctccaataggaagagtaaattgtgctagttcctctttcaccttaaaatcttctttcgtcacagaaatagtaacaggtaaagttccagaactgcttgtcgtactcgcagtgaccacccaaattttaccgatcgatttaaagaacttagataatggaattttcgctatgaattttaacataaacaagtacataaaaatgatgacagaaatcaaacctatataatcaactaaaataaatttgcccaaaggtccaaatattttcaaaccatattccccaatcgtacaagccattaatgcagccacacctattggtgaaaacgacatgatgattcctgtcattttatacattacttgtgtaccttcttcaaaaaaatgtctaagggtgactgatttgtttcctattaaaacgatggatatccccaagaaaatagaaaagatgataatttgcatgagatttccttctgctagagcctgaacaggatttgatggaaatagacctaatatcgtctctccaaaagtaggaatatttgcagctttatattcagatgaggtcttgatactatcaatatctattccattccctggtttgaataaatgcgcaaccaaaagacctattccacctgctattaaagtcgttccgatataataaatcaaagtctttgttccaattttctttaatttttgaacatcaccaatactaaaaattccagaggtgatggagaaaaaaatgagtggaacaactatcattttaatgagagttaagaatatatccccaataggtttaatgattaatattttttctttaaagattaaacctaacactattccgatgacaaacccaataaatacttttgtaccgagacctaatttcttcattagtagttccccctatttaatgagtttgcttattctcttagtgttagataactcttttgttatacataaaaattgatcaatatcctcttctgtatgacaatggaacggcgaaacccttatcgcacccgttagtccaatggcttcgagtatacgttttgagtagacactagtattcactctttcataaacggtaattcctctatcttgatattcctttctcagttgttcatcatctctcccctcaattcccatcgcaacaatgagatctcttttcgttaaatcaggataatccgcaaaaacttttacgttctccatatatctcaatccctcgatcttttcactaccttcaagaagtctatggagtagtgctctttcgtgaagaactattttttccataccctttagatacctatctcttctagacatttcttcaatacagtcgtatgaacccagccagcatacatagtcgacaacagctgaaatggacgcaaagagcgaaggtgttggtgaaccaagttcccattcactatcatcttttgctattaatttttgatgtggaagtttcgataatctttctgaaacataggctaatccaatacctcttgacgccataaacttatatggtgcaaagtttgctccatctataccaagcttttctacattaagagttccatgcggcatatgctggactgcatcaacaataatatataaatctggttttttctttctagcagcttttatcattccttcaagatccatgatatttcctgaaatattactggaagcaatgacgcttaacaaaatcgtattctcgtcaattttatcagcgatcgcttcgggatcaacaaagcctgtattcacatttgctttagcaattctaaattctttattgttcttttgacagtaaaattctaatgaatcataagcagatggatgttcaatattagtcgtgactgcattcgttccttcaacattttcaataatagttgataccattttaaacattgcttgagatgctgttaaatccgttatcaaagaaccggactcagccccgaacatgacactcaacacatcattcttacatttgtccataatgtcattcagatctgctgccctttgatggtacctttctggacaatccggtaacaaatcaatcttttctttcaccataatagcttcctttagtcttaaagagcctcctgaattatcaaaaaaaagtctttccccatagtcaggatcgaaagatagaaacgagaatttttcacgcaatttctttaacagatgctgatccattaatttccctattttattatctttcaacatatttccccctcaacaaaacaaaaatgtttttaatcattctcaaaaaatgaaacttgaataattttcttcaatactattattattaaaggttcttttttcgtcagtttttttgtaaaaaaacatgacagattttttaaaatatataccccttccaaaattctgatttaatacacttcatagaaattagcattaatagtcaaccatacaagcaagcgtttacatttattcattttttaaaaaaaatgaagaatttatttcattttgattttatcatacacaatttgtttttaacaatatttttcgaaatattagaaaattattttagatttcctgttccattatagatctttgcatctaagatgtttttctaaaattgatcaacagtaatttaaagtaaacaaataataacccaccaattagaaaattggtgggttaatggaagtcacattctatgtaaatttactatttctttgagtgatgcatgattgtaatacagcctttacttcccccttctttcagaccccaaagaattcataataccaagtgcactcctgacatttaaacatcatatttatttcaaatattcttttcattaatacataccgaaaaggcttatatgtttattaattctttctaatttttcctcactatgagtgactgtcgctcgacttacatgtgtacatattaactcagctaaaaataatacaggtgtgtaagaattgaagaatgcattactatccactgagactaaaagtaggacatcagcaaaatgtgctataggtgctgtggctttatcagtaataataacaacttttgcattgatttcttttgccattttggctgctgcaaagtccagctcagagtatcttgggaatgaaaaaataaggacacaatcatccttactacatgaagctaaggaatcaaacggggtaaatgaatgattactattaactactacattatcaataatctgattgaggaaaactcccattatttctgtcaaaccagttctagctctactgcctaaaatataaactcttctagcgccaacgatataattgattgctttgttgaactcttcagatgaatttttctctgaaatagaatatatatttttttcaagaattttcaaattgttattcagtaaatctgactgtatcactttatcataacttaattttaatctttcagaagggatggtcacatcatcagaaattgctaagcttttgtcatagtactgctctctaagatatttttgaaaatcactatatcctgaaaagcctaactttttcggaaatcgaataatcgtagcattactcacttttaatctatgagctaattctgttgaagtcacaagacatgcttctcttatattatttaaaatgtattctgctatttcttcttccttttttgttagtttagtgttacttatcattgttttcaacgacttttgcgataaatccatttgacatccctccatgttcccttatattgattcattatattaggggaatagaatgattaaaagcactaagtatttttataagaagttctcaatttcatgataaagcacgatactaaatctcaattgagatgatagatggattttaatgtaatgcacatttttacagcaattatgagcggtgagtcatacgcataaaaaggggattgaatagccggccgaggatgaaactttcgtgagtacgacagcggggagacagcccgatcaaacggactgtctctacactatcatgatttaggcgcaagatgtgtttgtacgtatgcttcaaaaggttgcagaagcggttttttcgatacttcttcctgttcatgtatcgtaacatgatcctctgtcacgacaacacggcctgttggtgttagtttggatgcaagcggccttttgttaaaaggagaagcttcattttcataaatctgctttctcatttggaccaatgtaggctcactcacctcttccaatgtgaatgcatagcctgtttcagcgccttctcctctatccaattggagaagatgcgtacctttttcagttttctcttctttgactcgaaaccgaatagacgctccttccacccattcctcagtaaagggtacaggctggagaggtaaattcacaccaaaacccgcatcaatcagataccgttcgctgtgatgattcaatgtcatggctacgtgcgtaccatcaattgcccatgtgccagcttccttgttatacacggtcccttgaacgagctgtacagcgagtcctgcctcttttaacacataatataaaagaggattgagatcgtaacaaagacctcctctgttgctttcaagaagatgctgcttcaacccttcttgattcaaggcataggattgtttgttcagcacagatctattttcaaatggaaaggtgtaggccatcttttttaataatgcaggcaggtcatcaaaggtgatggactgtccttcatatccgatcttctgcaaaaatgctgattgcatcatgttcattcccttctaaaaaaactgagtctgtgaagagactcagttttcttgattgataaaatccgttaacgcatcaatagcttcttgttcatccgcaccatctgctatcagtttgacagtgaccccagagctgatcgcaaggctcatgagacccataatgctcttcgcattgactctttttccgtccttctctagaaaaatttcagccccaaagcgattcgcttcctgtacgaacaaagcagcgggacgtgcctgcaagcctgttttcaactggatggtgaccgttttttccaccatatgatctgcctccctttttcattctcctatttgagtgtaacagcttgtccgtttcgtaattgttctgcaatttgatctagctttcttaagcggtgattaatgcctgatttgctgatcttgccgctttccaccatttctcccagttcttttagcgtgacctcttgatagtcgactctcagttttgcaatttcacgcagcttatctggcagggcatcaagtccaattttttcatcaatgaattgaatgttctcgacctggcgcagcgatgcaccaatcgttttattcaagttggctgtttcacaattgacgagccggttcacggaattccgcatatcacggacgatccgaacgtcttcgaagcgaagaagtgaattatgtgcacctacaacacttaagaattcggtaattttttcggcttctttcatatatgtgatgtagccttttttacgctcaagtgttttactgttgagatgaaattgattcatcagctcacaaagggcatcattgtgttctttatatagtgaaaaaatctcaaggtgataggaagacgtttctggattatttacagaaccacctgctaaaaaagcacctctcatataggagcgcttacagcatcttttctttacaagctcttctgaaatattgcgctcaaatacaaattgctcacctaatattttcaaatcctctaaaatggttttcgctcgttctaccagtctgacaatatacacattattcttttttaatctcattttcttacgaacgagcagctcgactgtaacatcatatttctttttcagcagcgtataaatccgtcttgcgatagctgcgttctctgtttgtatatctaaaattaattttcgattagagaaagataatgaaccgttcatacggatgagggcagaaagctctgcttttgtacagcagtccttcacgtccagattagtcagctctttttttgtttcggatgcaaatgacatccttgccacccccattcctattttttcttatgcagcaggtcgacaagcagcgcagctactttcagcgtgtcgtgacgaatcacatgctggtcgtatgtaatgatttctccaggaatgacttccagtcccattgccttgagtacatctgtgtcgaactgtacaggctgtgcctgttcttctgcatattttgctttgatctcttctggaatttctttattgttcacaaaaatggtatcaataaatggacgaaccatatgatcgtttaatgcctgcacatgatcagctgcactgtaggaaagcgtttcccctggctgcgtcatgacattgcaaatatacacttttttcgccttagaacgaatcacttcttcgccaatatgcggtacaagcaagtttggcaaaatacttgtatacaagctgccaggtccaaggacgatcaagtcggcttcacgaatgacttgaatcgattctgggagcggctcaatcgtatcgggtgtgaggaacactcgtttaattcgctcaccataggttgggatttttgattctcctgttaccacttgcccattttctaattcagcatgaagaacaacacttgaattcgctgctggcaagacttttcctctcacatttaagaccttgctcatttctgtgacggcatgaaaaaaatcaccggttatatttgtcatggccgcaagaatgaggttgccaagagagtggcctgttaagtcatttcctttgttaaaacggtgctgaaataagtcttctacaagcggttcaacatcagagagagctgcaaggacattccgaatatcccctggaggcggaatattcaaatcatgccgcagtctgcctgagcttcctccgtcatcagcaaccgttacaatagcggtaatatccactggctttgtttttagccctctgagcaaaacagataagccagtgcccccgccaagaatgaccacctttggaagtgtcgtcatctattttctgcttctcttttcaatgtcccggtgagtgacatgagtatagtagtcatttttaaaatactccgataagtagttcgctagcgtcactgatcggtgctgtccgcctgtacagccaatagcgatcacaagctgacttttcccttctcgtttataggccggaagcataaagctgagaaggtcaattaatttctctgtgaatttttgtgtctcgctccatttcattacataggagcgcacttcttcatcgtttccagtctgtggacgcatgctctcaatatagtaaggattcggcagaaatctcacatcaaatacaagatcagcatcaatcggcagaccgtatttaaaaccgaaggacatcacattcactgtaaacacctgcccttggctcgtggcaaagtgtgcgacaattttttctcgaagctgtttgggttttaaatccgatgtatcaaaaatcatttgagcccggccttttaactcttctaacagatcgcgttccatctcgattccttcgagcggcaaacctgtagtcgcaagaggatgcgaacgtctcgtttctttgtatcttgagacaagcaccttatcgtttgcatctaaaaataatattcttggtgtgatccagccaagatcactcatttcatctaaggctgcaattaagctgtcaaagaattctcgtccgcgcaaatccatcacaagggcaaccttgctcatcttagaattcgattccttcatgagttctaggaactttggtaaaagtgatggcggcaagttatctacacagaagtaacctaaatcttcaaagctttgaatggcaacggttttccccgcacctgacattcctgtaataatcacaagctgaatatcttcttgtttgtgcgtattcatgcctgcttcctctccttctttataaaaacggttcatatattagtctccttgaggatctaaccgataagcaatcaattcaaaatcaggtgtatacgtaaaagtaccgtgcagaagtccttttccctttagcatgaaatcaagaatatgagaatctcctggtgccatcggtaaatgcggcacatcctttacttcatgccactttaaaatgccttcctctgactctgtcacgttttttccagtaaatgaatctgccataaaggtaaacatcatccactcttgaacgatttgatcgccttcttttatgataaaggtaaaaacaccttttaactgtggatttaaaatataaattcctgtttcttccctatattctcgaacgactgaatccttaaccgattctccgctttccattttgccgcccggcgctacccaccagccccgtcttggcttttgcagcaagagaacttgatcttcgtgatgcagcacacaattggttactcgttgcatcagctgtcacctactcttttatgtctttaacttattatacaggttcatcctgactcccacaatgaacatgccccttcttcaccgaaatcagaccgaatttcgtctgaaaggagtggcgggcaatttctctactctttattttacagcatctaatggttctccatgcgtcatttgtgaacatctcatgaatttctgattttaaacaaaaaaaaggacacggattctcatccgtgccaaacatgtattccttataaaagggggtcaattactagttttatcataacggaaaattgtttcacccgtgttacattccagttaaaagcccatgacgctatattaaggatttacgacagccttttatttcgctgctttcagcttttcagcaagttcttctacataatgctgtgcgctttgtgcggcaatacttccgtcacctgttgctgtcacaatttggcggagtgttttttcacgaatgtcaccagcggcgaaaatgccttccactcttgtttccattctttcgtttgtctcgatatatccttcttcatttgtaatgccaagattttcgaatggtttagatagtgggagcatcccgatatagataaagacgccgtctgttttaaaatcttcttcttcaccagtcaccgtatcaatcagggtcacactgccgactttaccgttttcttcattgatttgtttaacggttttgttccacatgaagtcgattttttcattatcaaaagcacgcgcttgtaaaatgctttgggcacgaagtttatcgcgtctatgaacgattgttacttttgacgcaaagcgggtgaggtatacgccctcttctaccgcagagtctcctccaccaatgacgacgagctctttgtttttaaagaaagcaccatcacatactgcacagtaagagacacctcggccgccaagttctttttcacctggtgcaccgatttttttgtattccgcacctgctgaaataatgacagagcgtcctttgtattcttttgaaccggctttgacgattttgtactcttcaccgtcaacgatttctttgatatcgccatatgcatactcagcaccgaatttcttcgcatggtcaaacattttatttgaaagttctggccctaaaatgctttcaaagccaggatagttctcgacatcttctgtattagccatttgaccgcctggaatccctctttcaatcatcaatgttgaaagatttccacgtgatgtataaacagcggctgtcattccggcaggtcccgctccaatgatgatcgtatcgtagattttttcttctgacacaactgtcactccctcttcaattgctgctagcatttcttattagaatgcccttgggtgatgcttccattcatgacagaaagcatcaattccactcttacttttattccttacccatatcctattaaatctgcggataataagcgaatcatttgctcatatcttcaaaaaaagaaaaagcttccttaaactgctgtttaaggaagcctgtttacggttatatagtaagtaatgatttattcaacgactcttcttacaacgccattgaatgcttttttccagtaaacattgctcatagagtcaactgaaacaccgcgagagctgttatcgttcaagaatgtaccgtttcctaagtaaataccaacgtgtccatttactttatacgtatcaaagaacacaaggtctccgcgtttcatgtcagatgcacttacagctcttcctttacctacaagcgtatctgttgttgtaccgccaactggtccaaggttgatgcctgctgatgcaaatgcccagcgaacgaatgaagaacagtcaaaacgacgtgcgttaatatcagcttgtgatctgccgccagcccatttatatggagattgtccaacaatggaagaacctgtgctgatcgcaccttcgattccgcctacgttactgctgacaggtgatccaccgccagtagatggcttcttgcttggtgaactgctgttgttgttattattattatcgttgttgtttgaagatccactgttactgttatttgaagacgggctgctgtcgttagttgagctgttgtcttctgcttgaacactagcttgacgctgctgttgtctttgtactttttcttcctttgctttttgagctgcttctcttgcttctttttcagcttgtttttgagcagcgattgttgcatctttttcagatgcaatgctgttagcctcactgtttaattcgctgatttgagaagaagcacttcctttttgctttttcacttgcttgaatagcttgtctttttcatcaagctgtttattcaagtcagtttgaagtgtttcaagctttgcaagtgtcttttgaacatcttcaagctttgtgtttaattcgttttcagacttttgaagctcagctttgtctttttcttgctctttaatgatttcgctgtctgcgttgatgagtgtagatactgcacctgcacggctgatgaaatcgctaaagcttttcgctcctagtaacacatctatgtatttcgtagaaccgccgctttcttgaagcgcacgtacacgctttttcaagaatttgtttcgatcttcaatacgtttttcagtatcagcaatgtcttttttcagtgcattgatttcttttttcgtttgttcattttctttttgtttttcttcgatttgatcacttgtttttaaagctttctcgtcaatttcctttagctttagtgcaagtgcctcttgttttgcttcaagctttgaaagctcatcttttttcttttgaaggtttttgttgacctcagattgcttgctgtccagctcttgtttcttttgttcaaagttctgtgcgtttgcttcatgagtaaatgggataaataaaccgctcgctccgatgaccgaagctaaaccgaaagtaataaactttttcacgaatagttcctcctttgacaatttccaagcgacattagaaagcagcaaattctctgcgaccaatctgtgctatctatgtctttcttcctgattgatcagtcagatgttgaccagattgtttctatcactaggtgtttcattatgtatagtaaaatatctaaatatatgtctttgttttaatccacgattttcattatacatgagacatcgacaaaatgagctaatatttttattacatttatgtttcaaaaacatgtcgtgattgtcatacttcgccaaatccttgcaaatcccacctttttatccaagaaaaaagcatgacctttttggccatgctgcaatcttctaaatctatttacctatttaatcaattaatgtacaaatgacttgttcatatttagacagtgtttgaacactgatttgaaaagaggatgcaatctcttttttgctcatagattcttcttgctcctgcatccataaataataagatgctgctgcccatgcaggcgcatttttcttatctatgccagaagcacgtgcctgctgaataatatggaataaccaaaaataaggcatatggctgtcaggctgaacagcttcttccaagctggatgccgcctgttttgtgaaaaccgcatcttctgaaaaagaccgttctttcatttcatcttcgtataagagcagctcaatgaattgctgttcaaaggctgttttcgctgcgcgtgcgtcaaggacagattgaagaacgtcacgttcccctttttgtttgcttacatagtacgccgtcagccgctcctcaatggagaccattggctcagtctcctcaggtttatcctgccatggcttgatttcatctgcatcgatatcttcttcgaccatcttatcccaaaccgtctgcgcaagcgttttatgacctgtataataagctgcgcttgcaagccaatataaaaatgtactatctccttgaaagcctgttttgtataaagaataaagccatttaaaggcccattcaaattctccaactagggcaaatgttgcgccaagcttataacgctgttcacttaatattggatacacgtgcgttaattgctttgctaacgtcttgaccttctcttcttctttttcataatgatagaagactagctggttgcaaagggcatgcagattacccggattttcatgtaaaacccggttcagcatctcttttgcctgatggatttgaccagaataaaaataggccaatgcgagattattatacgctgaccaaaattctggatactcaacaatcatctgttccagcatctcaatggcttcatcaagcctgccgctttccagtaagtgatttgcttgatcctgcttcacaatcaggtcatcctgatcgtaaggaaaatcttcgtcctcttcgtcactcatatcgagcaagtcgagaaggtcatcattttcatctgcaaattctccattctcttctaatgaagcataggcggtcgctgacctatatgcctcttgaaagagccctaaattcgcataattattggctttaaaatagtgacactcaaacatattttcatcaatatgctcaaggatgaaatcaagcagttcatttgattgttggtaatgacccatttcagtataaataatagcaagctgtgacagcatttctacattttcaggctcgagtacgatagcccgctgtatgagcttacttgctctagatagatttctttctctataagcttttagacctttatgaaaaaagtaatgcccatcttggaagagctggacgacttgtgtgtgattattttgagaagtgtatttactcactgataccctccatttcgaacagtgtaccgtgtgtagtataacatacttcaagagtcgtcacatagaacaaaagaaaaggaaggatttgttttacacttggaaaataaaaagccagaggtgtctccggcttttcactcaccttgatgacgtttttttaatacttttaatacatcatcaagcggcaattgctgttcacgtaataacacaagcaggtgatacagaagatcggctgtttcccatttcaattcttcttgatccctgtttttcgcggcaatgatgacctctgacgcttcttcccctacctttttcaggattttatcgacccctttttcaaaaagataggttgtataagcgccttctggcatttctgcctgacgtttcgcaatcacctgttcaagttcattgaaaatggcaaaacgatcctgctcttccgtttgacgcttcacgccttcttccgaaaagcagctatagctgccagtgtggcaggctggtccacttggtgtgacaagaacaagcagagcatctttgtcacagtcatatcgaatggatgtgactcgctgagtatgtccagatgtggcgcctttgtgccaaagttcgtttcttgaccggctgtaaaaccatgtttctcctgtttttagtgttttttcataggattcttgattcatatacgccaatgtcaatacttctttactttgagcatcctgtacaatcgcaggtatcaggcctgcctcattaaaggataattcgtttgcctgtttcatctgaccttcaccccgtgttctctcaagtatgtctttacttcttgaattgaagtctctttataatgaaaaatggaagctgctaaagctgcatccgcttctcctcttgtaaatgcctccagcatatgctgagcattgccagcgcctcctgaagcaatgacaggtacggtgacagcttctgacacaagctttgttaatcgatgatcaaagccctttttctcgccgtcagcatccatacttgtcagcaatatctctcctgctcccctcagcacggcttcttttgcccaatcgctaacctctatatccgtttgacggcgccctccgtgtgtataaaccatgtacgcttttttctcttcgtcgtactttgcatctattgcgacgacgatgcactgagaaccaaaaaaatcagcgccttctgaaatcagttctggtcttaaaactgccgctgtgttcacagatactttgtctgcacccgctcttagtatgcgcttcatgtcatcaaggtggttaattccgccgcctaccgtaaaagggatggcaagggttgatgctacttgcttgaccacatccaccatcgttttccggccttcatgagaggcagaaatatcaagaaagacgagttcatccgccccttcctcatcatatatctgcgctaattctaccggatcaccagcatcctttaagccgaggaattgcacccctttgaccacacgcccttccttcacatcgagacatgggatgattcgttttgtcatcatacgctgtcaagcccttcaattgcttcagctaaagtaaaccgctccgtataaagtgcctttccaatgatcgcaccagaaacgcctgactgtttttgtgctgacagctttcgaagatcggctaccgaactgataccgcctgaagcaatgacttgtttgccagtagcttctgctaagcgaactgtactttccacattaggaccagccagcatgccatccatttgaatatctgtgaaaataaagacctccgcgccttcctttgccaattctttgccgagatcctctgccttcactttcgatgtttcaagccacccctcagtcgatacgaatccatttcgcgcatcaatgccaatcgctattttctccccatattgcgcaagcatttttttcacaaatgcagggttagaaacagccgagctgccaaggatgactctagctacaccattgtttatataaaaagcaacgtcttcttctgtccgaatgcctccgcctatttgtacatttatatctaaggatgaagcaatcgccagcacatgctcatgattgacgcgattccccgctttcgcaccatctaagtcaacgagatgaatccactttgctccttcatttgcaaatcgcgtcgccatatcgagcggcgaatctccataaatggtttcttgatcataatctccttgcacaagccgtacacatttgccatttctcaaatcaatcgctggatacaatgtaaattcactcatctgttcaccctctgttcgtttgctaattgaataaattgtttgagcagcgccatgcccgttgtactgcttttttcagggtgaaactgtgcacctagcacattccccttgccgacaattgctggtacttgaacgccatagtctgcgcttgctaattgctcttctgcattcatatccctcacataataagagtgaacaaagtacgcaaatccttccggtaccccgtcaaacaatggggagggctgatgaaatgtaagctcattccagcccatatgaggcaccttcagcctttgcccatcctggtcacgatcctttaaaagaacgacacgcccttttagcagccccaatccttttgtacgccctgcctcttcactctcttcaaataacagctgcatcccaagacaaatgccaaagagcagctttccttcctgcactacttggtggataaacgcctcaagccctgtctgttttaacagctgcatcgcatcacgaaacgaaccaaccccaggcaaaatataagcatctgcctttttgagctcctccacatcagaggagacgatataactggcgcctgctcgttccagtgcttttgatacgctgaacaaatttcccattccgtaatcaatgacgccgatcattagagcatcccctttgtcgaaggaatccctttcacacgtggatcaatggttgttgcttcatctaaagcacgtgccattgctttaaaaatagcttcaatcatatggtgcgtattggttccatagtgaacaattacatgaagatttatacgagcttctaacgcaaacttccaaagaaactcatgtacgagctctgtatcaaaggtaccgaccttttgacttggaaaggccgctctcatttccaaatgaggacgattgcttaaatcgaccacaacctgagcaagcgtttcatccataggaacaaagctggagccataccgcttaatcccctttttatcacctaacgcttccttaaacatttgccccagcacgatgccgatatcttctgttgtgtggtgatcatcaacatccgtatctcctttcgcatcgacggtcaaattaaagtgtccatgcttcgtaaatagatcgagcatgtgtgtcataaaagggacatctgtttgtatatccgcttttccttccccatcaatctctaacgataacgaaatattcgtttcatttgtttgtctcgctgtttccgcctgtctcatgacgattcctcccgctttctcgattcaatcgaccttgcatgtgcctcgagcccttctaacctggcaaaagccgcaatgctatccctgtgtgtctcaaaggcttcttgactatatgaaataatgctcgttttcttttgaaaatcggtcacaccaagcgggctagaaaatctagctgttccgttggttggcagcacgtgattcggtcctgcaaaataatcgcccaccggctcagggctataacgccctaaaaaaatcgcccctgcgtgcttgatttgaccaagaaatgattctggatatgctgtcagcacctctaaatgctctggcgctaactgattgacgacgtctactgcacgatccatagaatctgtcacgtatatacggccatgatgttgtatggattgtgcggcgattgattttcttggcaaggtattcagctgcgtttgcacctcggcttgcacgttttccgcaagtgtcttagacggagtcaccaaaatactagatgccagcgcatcatgctctgcttgagaaagtaaatcggccgccacttcatgtgctatggccgtgtcgtctgctagaaccgcaatttcacttggaccggcaatcatatcaatatctacctgcccaaatacttcacgctttgccagtgcgacatatatgttgcctggacctgtgattttatcaacaggctggatactttctgttccataggcaagtgccgcgatcgcctgtgcaccgcccattttatacatctctgtaataccgagctccttcgcagcaacgagtacagcgtcagagaggtagccgtctttccctgggggtgtcacaaggacaattcgctgaacaccagcgacaagcgccggaatcacattcattaaaacagatgatggataagcagctgttccgccggggacatacacaccaactgcatcaagcggtgtcaccttttgtccaagcatagagccatcttgctggtgataataccaagaggatgccagctgacgctcatggtatgtgcgaatatgacggatagccgtttggatcacctgaatcatggctgggtccaagcgttcgaaggcttttgtcatttcttcctctgtgacaagcgagtcttcaagctgcaccccatcaaattgcttcgtaaaagactgtaccgcttgatcaccatttttcctcacttcttgtataatccgctgaacagccaggcgctgctcttccgtgcctgtatctaaagtccgcttgagtgagagtgtctctgtctcatcttcttttatgtaggtgatgttcatgatgtttcctccccttcaatgattcttgcaaggcgctgcgccatttcatcgatcaccgcatccttcatccgatagctcacaggattgacaataaagcgtgacgtaatatcacaaatatgctccgtttcaacaagtccgttttccttcagtgtttgacctgtagagacaatgtcaacaatacgatcggcgagtccgatgagcggtgctaattcaatggaaccattcagcttaatgatctctacttgctccccttgttctctaaaataggaagatgcgacatttgggtactttgttgccacacgcggcgcgacaccgccccagctggctcccggcaatccggcaaccgctaaatggcatttactgatctttaaatcaagcacctcgtacacatcacgagcttcttcgagcatgacatccttccctgcaatgccaacatctgctacaccgtgctctacataagtcgtcacatccattggcttcgctaaaataaagcggaggttttcttccggtacatcaatgattaactttcttgaatcctcgaattcctctggcagttgatatcccgcctgccttaacagccctgcggcttcttcaaatatccggcccttcggcatcgccatcgtcaacactttacccattttgctctccctttctagcgccgataaaataagtcacctgctcaaatgccttggtcatcgcgtcaatattttcaatccctgctaagtcttgcagcacgatctttttcccttttgaccgctccttttctgcaaaagcaaaagcctccagccgttgttctttactaaaaatcactgcctcctgcggctcattgatttcttttgcatcaagtgcttcaagcagacggtctaatcgaagtccgaatcctgtagctggtgcaggtgcatcgaaatgagcaagcaattggtcatatctgccgccacttccgatgactgacccaacatgatctgcaaatacttcaaacaaaatacccgtgtagtagctcatatgactcaccatgcttaaatctagacggatatattctgtacagccgtaatcttcaagtgtctcccaaagcgactttaactgcgtgagcacctcttttccttcttgtgaaacgacgatttcctctgcccgctctgtgacttcctggccgcctcttaactctaagagctgtaacagcctcgttttatcgatagaggagagtggtaattgcttcacatgctgacggtatcctacataattcttttcatataagaatcggcgaagaacgtttgcacgctctgtatttcccagtacatctacaaataacgtctctgctaaagcgacatgcccaatcgcgattttgaaggacttgagcccagcattctttaatgcgaatacgacaagcgcgatcacttcagcatctgcactaatcgaaccgtcaccaatcaactcaattccgacctgctcaaattctgatggccttccgccttctctttcctgcgcccggaacacattggccgcatacccaacgcgaagcggatatgcctgttcatgaagctttgatgctgccactctcgcaatgggtcccgtcatatcaggtctgagtacaagggtttgcccgttctgatctaaaagcttaaagagctgtgtatctgtaatcgccgattgaacaccgactgtatcgtaaaattcaagcgttggtgtctccatcaatcggtaaccccaaccattcataacctctattaaggaatgtctcacttttttcttcgtctcatacaatcctggtaatgaatcccgcataccatatggtttctcaaacataaacatgttcttctgcacctccaacacattaaaacgaaaaattccgaatcctttagttcgctaatatgataatatgctaacaaaataaagtgattaaatcaatcatttttattttctctctattttcatgaaaaatttgtggaattattacattcaagtgacacctgtcccttttctatatgttcgatgaaagaacgtgctataatacataaaaatattgaataaaacaggagattacagtgaagttcatccagacattaatcttaactttgttgtgcgcatgccttgtttatttcggctttatatacgtgacacaaatcgaccaagtcaaaaagacagcttcaccacacgaagcagccaaagaaaacgatacagcactcgcagctgaagaaacacgatcaacgaaaaaaacagacaccacctattcttccttaaaaggaagcaaaaaagccatggacgtcatcctttacaatcaaatggatgccccaaagctttataatggatgcgaagttacaagcttagcgatgcttcttcattacagcggctacgagcaagtgacgaaagacgctttggcaaatgaaattaaacgtgttccactcaattatgaaaatggcttaaaaggagacccacatgacggatttgtaggcgatatggagaatggaccaggtcttggtgtataccatgaacctatttatcagcttgcgaaaaaatatgcgggcgctcaagtcgtcgatttaagcggaaaacctgtcaaaaaggccatctatcaatcacttgaaaaagggtatcctgtttgggtgattaccacatccacctttgacaatacagataacatcgaaacatggaatacaccaaatggcaaaatagatgtaagctttaatatgcatagcgtggtcatcacaggctatgacaaggaacatgtctacttaaataacccatacggagaaaagaatcaaaaagtcgatcgcgaccagtttgaagattcttgggaacagatgggcagtcaggcgattatcattaaagcatagaacaatttttctttgaaaacatgaaaaaccatcctctatccgaatagaggatggtttttttcatggtgatgcttctatgatttccttcaggcgctcctcaagcttttcagctgtcatcgctcctccgcctacattgaagtattcatcccctttttttaatataagggtagggtagccattcacttgaagttgatgaaccttctcaaagtcggcatacgcatcattgatgacttcatttgttttcattcgttcaatgacgatattaggatcaagatgatgtgccagagcgatttcctgatacgtttcatcatcgctcaggctttttccgtcttgataaaaagccttttgcatcgatgcagccaagtacaatgcacgatctggagcaacggatcttaatgctgaaaacccaatggctgcagcctcagagtctaagacaaatgtcccgtttgctagcagcttctgataacgttcaccaaactcaacgccagttagctgactgatccgctgattcgcttctgatatatgtggatattcctttattggaagacttctttctcctacaaataagccgccagatactagcgtcagtgacatttcaggatgattctcatgcaaagtacggatactgttggaaaatccataacaccagccacaatacgcatcccatacataaatgagagacaattcttgatcattcatacgttaaactccttactcctcgttttttagcggcaacgaattgatttattctgcttcagatacaacagtaaaacgttctccaacatgggcagcctgctccatttcatcgacaagcgcaatagcgtagtcagcatagctcacatagctgtcacctttagaattgacaatcagctggtctttccctttcacataagaacctgtgcgtttgcctgctggatcaaagaatgcagcagggctgagaaaagtccattttaacccttcggtttgttgaaggtctttgaggttttcaccttgctgtgaagcagtcgccatatactcctttggaaattctggtgtatcgacaagtcttgttgttttggcttcatcaacaaaaagactgcccgctccgcccacaacgattaaacgcgtatcgggtacttctttcaaaatatcaatcagctttttccctgcctctacgtgaaggtgttcttgtccagcaggtgcgccaaatgcattgacgatgatatcaaaccctttaatgtcttctgcttgtaaatgaaacacatccttctcgataacagctaccgatgaatctgtcacttttttcgcatctcgaacgatggctgttacctcatgtcctcttgatagaacctcttttacaatttcctgtcctgctttacctgtagcgccaataataccgattttcatatgaattcctcctgtaaaatgatgttattcgataaacaaaggtgtaaccaatccagttacaacagaggtaaaaaaaattgaatagatcatccaatttttttgattaacacctgcgttagttcacttaatttgatctcagcaagcacttgctccatcgcactttgagcgcggcacaagattaactcaagcacagcttggatatttgcaccaatcggacagtcaggatttgggctttcatggatttgaaacaattctccctcatccaccacttcaaccgctttatacacatcaagcagcgtgatatcgtcttcactgcggttcagctgagaaccgcctttgccaagactcgttgagattaggcctgctttttttaatttactcataatacggcggatgaccactgggttggtattcacacttcctgcgatatcctccgatgtctgtaatgatcctttttcaagtgatagcaaggccagaatatggacagcgacagtaaatctgctgctgattttcatgttttctcacctctgttgtaatcattatagttacaccacaacatattgtcaacaaaaaaatctgccgagctactcagcagacttagattgacgtgctttcatttcttctttcgtataaatcatgcgcattggatttcctccaacaaatgagcctgctggaacatccttatgtacaagtgtaccagccgaaacgatcgctccatccccaatagtcacaccaggtaaaatggtggaattggctccaattaagacttcatcaccaatatagacttccccaagtctgtattctttaatcaaatactcatgggacaaaatggtcgtattatagccaatgatagtatttcgaccgactgtgattttctcaggaaacatgaggtcaaccatgaccattaaggcaaacgctgtatcttcgccgaccttcatacgaagaaaggttcggtatatccaatttttcattcccataaaaggcgtgtaccgtgcgatttgaatgaaaataaagtttttcaccactttgaaaaaagggactgtccgatagacttgtcttaacgaattgaccccttttacaggataacgatctgtttttctcaactcaatcagctccaacaatcgccagaagatcactcattttctttagcataaaatcagggcgatgctttaaaagggcttcttctcccttaattgaccaagcaacacctgctgtttttgtccctgctgcttgaccagacaaaatatcgtgataattatcgccgaccatcaccgcttcatgtggatcactgccaagcttggataatgccagctggacaggctccggatgcggcttctcattttggacatcatcgagcgtcacaatcacttcaaaaaatggctctaaaccggtcagcttcaatcccattaacactgtgtcacgtatctttgttgtgacaattccaagcttaaatcctcgatcctgcaagactttcaatgtatctaaaacagtctcatattcagtcacgagcagatcatgctgttcatgattaaacgtacggtacatctgaatcatgtcatccgttagatcagggtccatcgcagagaatgtatcaaataatgacggaccaatgaaatgaaggatctcttcacggctgtactgaccagggtaataatgatcaagcgtatgttgaaatgaagcaataattaattcattcgtattgattaatgtgccatctaaatcaaatagcacggtgttaatagttgattcgttcatatggcttcctttctaacagctgcgagatcgcgctttcgccaaatatagctaatggcagctgttaataaaatagcagatatcaaacggatgacaagaagcggccacacaggaatcccaagtggaataaatatcaacgtatcttcgaccactgcatggcaggcaacgaggaaaatgaaagcaagagttaaatcctttttactcacgccgtcctcttccactgccttcatcatcacgccagctccgtatgccagaccaatggttaatccagcgaccatcgtcatcgacgtattttctttcattccaagcattctcgtaaatggagacagccacttagacagcgtatggagccatcctaaatctctcatgaattgaatgatgatcatgagagggatgacgatacaggcgagctggagcacaccgagtacggctttttgtaaagcgacaaggacaatcatgtaccagctggaaggcacatcagccgtttgggcagccgtcagcagtccatattgtgccggctcctggcctccctgccaaacgagatgaatgacaatagccgaaacaacagcaagactgattctgaccagcaaaatgacagacactctcagtccaacctttgctgccactgtcgattcgatgatcaggttatgacaaaaggacagcatcacggccaatatgaacacttccttcacaggaagatctagtgtcaaaatggcggctatgcccgcatacaagttcagcacatttcctaacacaagcggaatggctgcttctcctgaaagaccaaacaatcccataaatggccgtatgaattgaatgatccaatccataacaggcgtatgctgcaagatactgacgagaatggtaaccggaaagatgacttttccaagtgtccaagttgtcgatagccctgcttttaagccgtttttccatgtctcccgcatccttctgatcccccctgctttaattcgatgagttgttctctttatacggaatcgatgcgtgaccttttattcttctaaagatgatcagcagaacagccactgcaaaaatggcaatcgaaatcatttgagcgatccgaagatgttctgtcagcatcaaactgtccgttctcataccttctatgaagaaacgaccgattgaataccaaattaaataagacaagaagatttcgcctctgcgcatcgatgttctacgtaataaaatcaagatcacaacaccggcaagattccataatgattcatataagaacgttgggtgataatacgtcccatcaatatacatttgattaatgataaactcaggcaaatgcaaattctctaaaaaggctcttgaaacagcctcaccatgcgcttcctgattaataaagttcccccatcgtccaatggcctgcgctagtaaaatactaggtgctgctacatcggctattttccagaaggacacctttttcacttttgtgaagacgatcgctgtcagcacagcacctatcagcccgccatgaatagcaattccgccatgccaaatcttcatgatttcatttgggtgctgctgatagtaatcccattcgaaggatacataataaattcgtgcacaaataatcgctattggaatggcaaataagattaaatcaataaacgtatctttattgattcctcttttctcacattctcttagtgcgagccagagtcctagtaaggctccgaccccaatgatcacaccataccaatgaaccgaaagaggtccgagctgaaaagcaatcggatcaattggctgaatcgcttcgttcatatagacaactcctattcatcttggccattgtcttcaatgacatcggctagtttacttgtaaattgttccgccgcattatgtcccatgcgttttaacctgaagttcatcgcagccacctcaatgataaccgctaagtttcgaccagggcggacaggaatggtcagcttcggtacatctgtatcgatgattcgcatcttctcttcttcaagtcctaaacgatcgtactgtttgccttgttcccaaagctcaaggttcatcacaattgtaattctcttatagcttctgacagccccagctccaaataaggtcatcacattaatgatgcctaatccacggatctctaaaagatgttcaatcagctctggtgcgcttccgactaacgtatcctgatcctcttgacggatttccacgcaatcatctgcgaccaacctgtgtcctctctttactaattctaaggctgtttcactttttcctactccgctttttccaattaacaatacacctacaccatatacatctacgagcacgccatgaatcgcggttgtaggtgcaagcttgctttctaaaaagttggtcaaacgactcgaaagtcttgtcgtttttaggcttgaacgtaacacaggtacaccattttcatttgaagctgcaattaattccttcggcacttcacgatctcgtgacaaaataattgcaggggtaatatcagtacaaagagacatcattctctgctttcgttcgcgttctgggagctgttcaaaaaaagaaagctctgttttccctaaaagttgaactctttcttttgggtaatatgtaaaataaccagccatttcaatacctggtctggaaagatcactgattgtaatgggacgattaatcccttcttccccacttaccagttcaagatgaaattgttccattatgtccttcgtacgaactttcggcacgcttcttcctccttttatcacaggcgattcagaaatacagctctattttatcactttcaatgatgatcccaaaacagtattttatcctgatcctgttttccgttcatcaactggtatagacaactatacttaaaaagggtaaactaagtcaaagacaatgactaaagggggcacaatcatgagcagctctttattgctctccaatattcatattgtgacaaagactgaaatgatgacaaacggttttgtcggtttacgcgacggcaagattgactatatttcaacatcaccaccgacaggaaattatgaaaaagtatatatttcccgggaaaacttttatttacttcccggaatgattgatattcacatccatggtggatatggagcagatatgatggatgcgacatcagaagccatgaatacactcgctgctaacttaccatcagaaggaacgacaagttttttagccacaactatcactcaaaaccatcaggaaatagagcaagcacttaaaaatgtcgcccagtggaaacaatacaatgaagaacaagcaggcgttcaggcacaatgtttaggtatccatcttgaaggtccttttatttctaaagataaagcaggagcacagcctgttcaatggatcaagcagcccgatcaccctctttttgaaaaatggctggatgcttctgaacagcttattcgaattgtcacgttcgcacctgaggaagaccctgactttgcttttctttccttgttgcaagaaaaaaatattattccttctattggacatacgaatgcccatcatgacatgattgaattagcagcaaagcatggtgcacgccatgtcacacatctttataatgcactgagttcgtttcagcatcgtgaaccaaacgctgtaggagctgctcttacgaacgaggatcttcatactgagctgattacggatgggatacactctcacccactttccatcaagcttgcctatttagcaaaaggaagtgatcgtttaataatgatcactgactcgatgcgcgcaaaaggactcgggaatggcacgtatgagtttgggggccaaacagtcacagtcagcggcgaaaaagctttactggcagacggtacactagcaggatcgattctgcgcatgaaagatggcgtcaaacggatgaaacagatcacacattgcgaatggacagagatcgcaaagatgacttcaactaatgcagccattcagctaggactggatcagcagcttggttcgatcgaagttggaaaacaagcagaccttgtgatctgggatgagtctggcgaactaatgatgacgatctgtcatggacaaatcgtctttgagaataaggaggccaaccattaatgaacatcattgaatttgaagataaaaaacaattaggaaaagaagcagcagccctgatcgcgcgcacaatcgcttctaaaccagatgccgtactcagcctggcaacgggcggtacacctcttgatacgtatcaagagttaattcaccttcatcaatcgcaacaattgtcattcaaacaaacaaaaacagtcaatttagatgaatatgcaggacttgagccagatcatgaaaatagttatatgacctacatgaaacgtcatttatttgatcatattgatcttccacaggatcagtattttcttccaaatggcgctgcacctgatttagaaaaagaatgcttaagatatgatcagctcattcaagatataggcggcatcgaccttcagcttcttggaatcggtcaaaatggacatattgggtttaacgagcccggtaccccatttaactcaaagactcatgtcgtgcaactagatgaaaacacacggcaggccaatgcaagatacttttcttctattgatgaagtgcctacacacgccatcaccatgggcattgcaagcattctttctagtaaaaagattctccttcttgcatcaggaaaatcaaaagcgaaagtgatacaatatttagaacagactgagatacatccagacttcccagcatctgctttgaaacttcatgaagatgtgacgattttgattgatcgagaagctggttcactacgctaaagctaaacacgagaggattttcacatgtttattgataagcagtcacctattccgatgtaccatcagattatggagaacttgaaaaaacagattgaggatggaacattagcacctgatacactcattccttctgaaagagaatatgccgaacgctttggtataagtcgaatgactgtcagacaagccttatcgaaccttgtgaacgaaggatatttgtatcgacaaaaaggaaaaggcacctttgtgagtcgaaaaaaatttgaacagccgcttcaaggtttaacaagctttacagaggatatgcgtcagcgtggtcttaaagcttcaagccagctgattgatttcaaaaaaaccatctgtccagatcacttgctgcctgtcttacaactctcaaatggcgatgctatatttgaactcaaacggatacgcctcgcaaatgatgaaccgatggcgattgaaacgagctatatccctgaagcatttgccggagatttaacaagggaacatttaactggctctatatatgaatatatagagactcaaacaggccttacaattgctcatgcaaaacaagagcttgaagcgaatgttgcttcaaatgaagaagcacatgtgctgtctatttcaataggcgatcccgtgctctcaatcgcaagaacgacttattttcagaatgatattccctttgaatatgtcctttccgtttatagaggagatcgttacaagctgattcatacaatggaaagataaacagtgcccttataaaaggagcactgtttttatttcctaagaaatgttgcttcacaatcatcttttgtatgaattttccatatcggcgaaatcgcttttccttgaaaacgatcttttgctacggtgtaccaataataatcttcgtttggctttaagcctttccactcaaagcttgcttttttgccgcttcttacgccacgcgcctctcctatcaaaacatttgtgtacacattgagttcaaaatagttggttttgacagatttcattttcggcgtcaaatccacatcgattgaaaattcatcttgatctccatacgttttaggatcgtagaaatgctcttgattcatgtaaggtgagtatgtcgtaaaatgaagctggtttttttcttgatcggctgttatcaatcgcataaacccttgtcccccttcaggtcctgactgataatcagcgagtatttgatatactttccggtctactttaccatccttgtcatcgtcaagctcatctactttcctgctcgctccgtgatagtgtccgctaaataccgccactatattgggatggcgcttcaccacctgatgaaagatgaggtcaccaatcggactgcggtttccactgaccaacaaatactcatggaaatttaaaatgacaatacggtctggatgctcagaaatcacacggttcaaccaatcaatttcatcttgcttaatcccccagcccatgtataccatcatataatcattgccaccggcagaaatgagatcataatgacctcgattgttttgataggattcaccataatacggtttatttgcaaaacgtttctcaccgaaatatttcccatattctgcataaaaaccgtccttatgtcgaacatcatgatttcctgctaaaacgccataaggaatctgatgctcatctaacacgcgcataaaggtatcagcacgatgccattgtttatcttttgaatcatccacaatgtcacctgtatggaacacatattgaatgtttaacttttctctctggtctctgatccactcgaccatttgtttaaagatatgaggatagctctttgcataatattgtgtgtcagacatccaaaccatcttatatggcttttgcgctttactgatttcatcctgtacaagcaaatcaaacgtatgattcttcatgtactgtctgactgacagcagtcctttcaggtaaaattccttctgatccttagcaaaatgataagtgattctatcccacttttcttgctgatgattccatgcatacatggtcacctttctacctgataatgaactccctttccacatcgcctcgacgacatccttttcacgtacatcttgatcaaccttgatttgaaaacgatgatagggaaaacgatgtaaatccttcgtttcaactgacttaccatcagcaaatgcaatgcgatttcgttcttgattagaaaaaatcgcttctcctttttcagtaaagctctttggcggttctgtctccgctgcatatttcaaaatcttcattgatggatggagtgatgtatattgataggcacggtaaaaggaataatccagcttatcattcgttggatccttggtgagcacagtttgcttagacgatttcatttttgtcttatctgctacacgttctggtggttcagggtgctcatgtaccgtcttgaattcctttttcaacgttgacatgtttcctgcggcatcttttgctttaattatcaacgtgtgctcccccgggtttaattcgctagaggacgtctggtatggcaaggaaattggcttgtcatctacatatgctttcatctcttctatgtcactccaacgatccgttacctttgcttttaacgtaaaggctcctttatatggatcctttgtttggacgttggttttaatttttggccccgtattatcgaccatcacacgtacagatgcatgctcgtctgaggttttggcctcaatcaggtgcggtccctctttcaaccttcttgtatcccacttcatatacgttgaaacataagcttcttttggtatgtcaaattgaaatgttctgacctttttggcgttaccgctgtctcccattctccattctttttgcggctttgcattgattggaggaatttgagttccattcgacagaatcatccgaacgttttttagttcaaaatcatcgtgattctctccaggcagccgatcaactggagaagattttgttcctgcatggaaggaaatcgtttggagacctgcttttttcatctctgcttctggtattggcattgtataggtacgatacacttttgtcgaatcatcaaaaatagaaagtaagtgcttacctatggacacaccatttttaaaatataaatttgtccctttgacatcaaatgcaatatatggatctgcttcaagggcggaaaatacttgctgattccgctttccatctatcaataattcaatgctttttttctgatcagacgtcgcctttaatggaaataatcctgaaaccgtatctccttcttctacattgaatcgaaggccatgagctttgctaacttgctccacatcaatctttttttccatcgtcattgctgtattttcaccgtctgacgcttcaagctgatattccaattgttctttaccaatcaactcaggtgagtaaataatgtgatgaaataaccggtcgttatgatctttttgaagcagtatttccttgaaatcatctttccgatttgttcgatagcgaagcttgacggttttgacgacctgatcatcctgtacatctgctttaatctctatgctttcagttggttttactggttttttcactgtcatatcttcaatcacaggtttatggatatcctgagacatttcttttttctcagatggaatttgtgcttttagcacttttccaggcgtaggctcttcttcaattttcgagatcagcttcatttgcgaagtaccgtccattggatatttgaacagcaaagatttatgctcactaaaccatgaaggtttcaagcgaaatgctgctgaagaaatctcctcccctatatttgttgtgatggaaacaagacgagatttagagttggacagccctttgctttcgatgacagatacatcctctcccgcttttaattcacttttgtacatggcattgaagtccgctatagttaaatgctcctgcccttttttcctcagccagaaaacatacggttttccaggcgaaagagtaactggatgtgtgtgaaaggaatacacatcatccatgtcggttccttgtgcaggattgcgatagcgaagctgataatgtttaagagagatcggctcatgtgttgtgttatatacctcaataaattcaaatgcatctttgcctttgcgattttttgaattgaccacaatttctgtgatgactaagtccggaatgcgtgaaagatcctcttcaaatccatttaagtggacagattgttctgccgttttgatcacggacttttgcgtaagaaactctgtatagtaacgaacggttgaattccataattgatctggtggaattttcgctgtaaattctggcttcatacctggcagccgttccattgggatcaaacggtaccctagctcatcactttgtttataatacaagttcgcagacaaaatttgttccgcatccgtaatagacgcacgaaactggagatcacggctttttccccctagaactggacggacatccacatgaaagggatcaaagataaaaggagaaaaaggcttgtccggtatattaacttgtgtttgaataaaaggccctgctgaagcaggctgattgaaacaaaaaagaatgataaaaaaacataaaagcatgatttgtctgctcacgttcaccatcgtgcaccgcctcccttcggatattgtgtctcctgaaggaagtttttatgtcagatgaaacggagaaacgatacaaaaagggtcaaaaaaaaaccgttagctttttttcgctaacggctccacaattcctttttgtattaacagatggaaaatggataatatgacagccatccaaatggccgttccaaacccatcaatgttaaaactgtcgcccataaaacttgatgtcatcataagtgtgatggcattaatcacaaataagaacaatcctagtgtgaggacggttactggaagcgttaaaatgatcaaaaacggcttcactaaaatattgagcaaggataaaatgatacttgccacaatggctgcgccaaacccttcaatatatacgctcccaagccctggcagaatgcctgaatcaaaatatccagcaatgacgattaaaagtaatgcatttactaaaatactgacgatccatctaaacatttagttagtgccttcttccggaacaacaaaataccagatgaagtagactaggaaaattggcataaatgctgtcataaatccgatgatgaccgttaaaatgcgaagcagggatgcatcgacacttaagtattcggcaagtccaccaacaacacccgctatttttttatctgttgctgaacgataaagcttcttcatgtagaatcactccttgtctgattggtgcttcacttgtattgaacctgtttttgtttctgcaaaaatggatatactgttcactgcctgttgattggctttgatcattttctctttttgtaatgtctcatttttctctttaatcatctctgcatcaagcaaatcgtgagaaatagacccaagattgcttttcagctcagcggtcactgcacacgcacgcgggatctggacgtccacactgcctgttgtcgttttcgcatagatggaacggcacttctcatccgacagctgaacagcaatatttccgttaaagctttgggcatcaattgattcacttttcccgcgcaggtcaataagcccattaatggtttctacttcaatcataccacactcgtgatccgccagtttaatttgtccgtttgctgtttcaattccaaccttttccgcctgtaaagaggcaaaagagacaacaccgttggtggttttcgcagcaagttcttttgtctttagcttttccccgcgaatcggaccattaaacagcttaaccttgattttatcgtattggatacgcggtacatataaagtaacattgactttcattgtcttcttttcggtccggataaaaaatttatccccttcgaggccgcagtccaattgattgagaaattgctgtcttgcctgctctccgtcttctgcacggtagattttcgcatggcattctgctcgaatatcgccatcgtcccaaggcatcagattgagactgccattcgccaattgaatatctaagtaagtgagtgaggcgtctttgaactgaaaaatgtgctcaacgtcgaccgactgtccaaagttcaaatcaagatctacgtctttcacctttttcaccgcagaatctaaccagccaaacagctttgcaccaagattttcggtaccagttcctttgctctctgtgccagctttttcttcatgaaaggtgtgatcagtcgttgatttttctaatgaaacagacgggctttcctccagtttttcaagcagcgtaatcgcttcttttgccgataatgtcccgtcttctactaattttaaaatgcgttctttttcattcatacaaagccctcctacgatttgatggattgaagtactttaataccttgaatgatattccaaatgacagaaatcaaaaatccaatagcgactaaagaggataagatgagcatcgtgatcactggcatgagtgagtcacttgcctgtgtcgacaataaaaaaggaattgacccaaaaaccagcaacacgcacgctgcgactggcaaaacatgtgaccataatgcccgcaacgcgtgccgtttcggttccttttggtcgactacaaaatatgccacaatcggtacaataaacggcataaaaaagacactaaaataacaaattgatgcaatgatcgactgatctctattcatatatattcgctccttcatgatgaaaattcctttctaactcatacgtttattgcgtatcaaaagtttcaaaatcattcgatttacatatgaccttagacacaaattacatctttttgcacctaagtgtagattcttcacggattaccctttaaaatatgttgaaaagatggtgattatcattatagggggtaattattttgacagatcatcataatactaaccacacggctcaaacgcttttagaccttatacagaaacaaaaaagcatgaacagcgatatgatcagggagcttgagaccattcatccgtctcatccaaagtatggtgatatccgttatttaaaagtactgctcgacagcagcagcacgcatattttaaaggatttaacgcaaatcagtcatttagtgccaaaggaagatgcgcaataaaacaaagccccctcttaaaagaggggggtttttatgatgaagtcacactttctgtttctttgaccaactgtttcattcgtttacggtcacgctctaaaacaggctttaagtattgaccagtgtaagaagctttttcttttgcaatctgctcaggagttccagaggcaatgatcgttccgccgcctgcaccgccctctggtccgagatcaacgaggtaatcagcagccttgataatatcaaggttatgctcaatcactagcaccgtatctccgttttcgaccaaacgctgaagtacttttaataaacgggcaatatcatccacatgcaaacctgttgtcggctcgtctaaaatataaagagaccttccgtttgaacggcggtgaagctcagatgccaatttcacacgctgtgcctctcctccagacaatgtcgtcgcaggctgtccaagtgtaatgtaccctagtccaacatcaaaaatcgtttgaagcttccgcttaattttcgggatgttctcgaaaaattggagtgcgtcctccacggtcatttcaagcacatcagcaatgtttttccctttatatgtgacctcaagtgtttcgcggttataccgtttcccgtggcatacctcacaaggcacatacacatccggtaaaaagtgcatttcgattttaatgatgccatctccgcgacacgcctcacagcggccacctttgacgttaaagctgaatcttccttttttataccctcgtacctttgcttcattcgtttgtgcaaacacatcccgcacatcgtcaaatacacctgtatacgtggcagggttagatctcggcgtacgaccgattggagattggtcaatatcaatcaccttatctaattgatccattcctttgatttctttgtgctgtcccggcttcgcttttgctctgtgcagtttttgcgcaagtgattttaaaagaatttcattcacaagcgtacttttccctgaaccagacaccccagtcacagctgtaaagacacctagagggaacttcgcattgacgtttttcaggttgttttcttttgcacctttgatctcaatatagcggccgtcaggctttcttctttcgatcggcaacgggataaatttctctccagataaatattgtcctgttaaagatttcttgtccttcatgacttcttccggcgttccagctgaaatcacttctcctccatgaactcctgctccaggtccaatatcaatcaaataatcagcggctaacatcgtatcttcatcatgctctacgacaatgagggtattcccgatgtcgcgcatgtttttcaatgtcccgatcaatcggtcattatcacgctgatgcagaccaatagatggttcatctaatatataaagaacacctgtcagccttgacccgatttgagtcgccagacgaatccgctgggcctctcctccggatagtgtgccagccgatcggctcaatgtaaggtaatctaatcccacattatttaagaaggacaagcgctcattgatttcacgtaaaatgagctgagctatctgcaaatctttctcagacaactcgatttcaccatataaatcaagggcatcagaaacagataaatcagtgatttccccaatatgtttgccattgatcagaaccgcaagcgtctcttttttcagacgataacctttacatgtcggacatggctggttcgccatatatttttccatttgctcacgaatataatcagagctggtttccttatagcgtcgttcaatgttacgaagaacaccttcaaattcaatttcattttcacgtacctgaccaaaatcattttcatatttgaaataaatccgttcagagccgctgccatataaaattttatcgaataaatgcgacggtatatctttcactggaatgtccatgtcaatgccgtaatgggtacatactgcctcaagaagctgaggatagtattgtgagctctgcggctcccaaggggcaatggcatgctgtcgtaacgtcaaatccttattaggaatgacaagctcagggtcaacttctagtttagagccaagcccatcacagctcggacaggcaccaaaaggactattaaatgaaaacattctcggctcaagctcaccaatagaaaatccgcagtgcggacaagcatgatgttcactgaataacagctcttcttgtccaatcacgtcaatcatcacacggccttcacctagtcgcagcgccgcttcaagggagtcagacagccgagccgcaacgccttccttcaccacgattcggtcgatcacgacttcaatggaatgcttcttgttcttttcaagctcgatctcttctgacagatcttccatctctccgtcgactcttactcgcacatagccttgctttcgaatttgatcaagtactttgacatgtgtccctttgcggccagatacgaccggcgcaagcacttgcaatttcgttctttctggatattctaaaatacgatctgtcatctgctcaatcgtttgggacgtaatttcaattccatgtatcggacaaatcggtttcccaactcgagcatacaaaagacgtaaataatcatagatttctgtaacggttcccactgttgatctagggttccggctcgtcgtcttctgatcaatactaatcgccggagaaagaccttcaatggcatctacatccggtttatccatttgaccgagaaattgacgcgcatatgctgaaagagattcaacgtacctgcgctgaccctctgcataaatggtatcaaaggcaagcgacgattttcctgaaccagataaacccgtgatgaccactagctggtcacgcgggatattcacatcaatatttttaaggttgtgggctctagcacctttcacctctattcgttccatagccatcaggcaatcatccttccgcttttagctctagcaatagatctcttaattctgctgctttttcaaaatcaagcgcttttgctgcatctttcatttccatctcgaccttttcgatcactttttctcgctcttttttgctcatttttgacagctttggtgctgcatttgtttcatattcttccgattcctcatgtatctttgttgctttaatggcatctctaattttcttatggatggtttgcggagtaattccatatttctcattatacgcctcttgctgctctcgtcttcgtttcgtttcttgaatcgcaatatccattgatttggtcattttatctgcatacataatgacccggccttctgaatttctcgctgcccggccaatcgtctggataagggatctttcagagcgtaaaaagccttctttatctgcatctaaaatcgtcacgagcgacacctctggaatatccagtccttcacgaagaaggttgattcccacaagcacatcatattttccgagacgtaaatcgcgaataatctcaatccgctcaagggtcttaatttctgaatgaagataattgaccttgattccgatctcttttaaataatctgtgagatcctcagacattttcttcgtcagcgtcgtcacgagcacacgctcatttttctcaacccgcgcatgaatttctccaattaagtcatcaatttgaccttcaattggacgcacttcaataatcggatcaagtaaacctgttggacgaataatttgttccacaacctctggggttttctcaagctcataaggacccggagtggcagatacatgcacaatatggttaatatgcttttcaaactcatcaaaggtgagcggtctgttatcaagtgctgaaggcagacggaatccgtgatcaaccaacacttgctttcttgcttggtccccattgtacatcgcgcggatttgcgggatcgtcacatgtgactcatcgacaacaatcataaaatcatccgggaaataatcaagcaatgtataaggtgttgaaccaggaggacgcaaggtcagatgccttgagtagttctcgattcctgaacaaaagcccatttctctcatcatctcaaggtcatatcttgtccgctgctcaaggcgctgcgcttctagcaattttccattatctcgaagcttttcgagctgctcctcaagctcttgctcaatattaataatcgctttttccattttttcttctcttgtgacgaagtgagatgctgggaaaatagccacatgttcacgatcaccgagtatttctccagtgagtgcatccacttcacgaatacgttcaatttcatcaccgaaaaactccactctgatacaatgctcatcacgtgaagcagggaaaatttcaacgacgtctcctcgtactcggaaggttccacgctgaaaatctatatcattacgagaatactgaatgtccacaagcttacgaagaagctgattacgttcaatctccatttcagtacgtaaagacagcacaagctctcggtattcctctggcgaacctaagccataaatacaggagacactggcaatgatgatgacatctctccgctcaaataacgaggacgtagcggagtgtctcagcttatcaatctcatcattgatgctggcatccttttcaataaatgtatcagtctgaggcacatatgcctctggttggtaataatcataataactcacaaaatattcgacagcattattcggaaaaaattctttgaactcgctgtatagctggccggcaagtgtcttgttatgtgcaatgacaagtgtcggtttgttcacttctttgatcaggttggatacagtaaaggtctttcccgtacctgtagcacctaacagcgtttgatgctgtttcccctgttggatgccctcgacaagcttttcgattgccttcggctgatctccttggggctgatagttagaaactaattcaaagcggtcactcacatcaaagcctccgtttcgttacgaaatctatctaatgaatatattatcataaaagaacacaaaaatacgaactaaagttcggctcttacttgatttttatttccaatacagtcataccctctcttcaatggcaaataaccctcttacgaaaaccttcctttcagtatggaacattttggtgagagatattcgatgagcagaaaaagagaaaaaaaagaaagctgcactcactagaattcgtaagcacagcttaaaaaacgtcatctttcggcctaacacgctcttgatgatgacatcaatgatgtttttcagccttttctctcttttcaatttcttttttagccatatataatgcaccagctactaaagaaatgatatctaatcccacaataaagtaggtttctgtatagcccttcatgtacgaagcaaataaaagcgctgctgttaatgcaatgcccacataatgattataagtaacctttgaaaataaaataacgagcaggaaaggaaaaacaagtgcaaaaatggcttttgtaatcacaaaaaccctccctcttcatggtctactcccttgattatagtaaagtttggcatattgaacaattcacagttttcaatttcacctatttttctttctgctcggagacttttgttatagatatagaaggaaattagtgagaatgtcccctttgtaaagataggtctttccgtctttgacagtaacatccaataaatcctatgattaaaatgatagtgcgcactatcattttagaaacgatagagagacagacaaaccattggctatttggataagggggcattcccatgtattcagttttatttcatgcggctgaagaatcagcagcactcgcaggggcaaagggcctaaatttaatcaaattaaacaatcacggcctaccagtcccagatggatttattatcaaaaccaacagcttttcaagctttctttcatatcacaacctgcatccaactgaacaaaaccttgctgacaaaatcaaagaagcatcgtttccttctcaaatggaagcagaactcctttcgtcctttcaatcattgcggaagacttatccctcagttgcagttcgatcctcttctgttgcagaagatctcgaaggtgcctcatttgcaggacagtacgaaacttatttaaatatcaaaacaaatgaggaattcttacaggctgttaaagaatgctggtcttcttattttggagcgagagtgacagaatataaggaagaaatggatgaaaacgaggaagagatgccgctcatggctgtcgtcgttcaagggttgattcattctgacgtctccggtgtcatctttagcgagaatcccgtaacaggaaaaaccaatgaaatgatgctgacagcaagctacggactaggagaagcaatcgtctctgggcttgtgacaccagacacatttgttatagacaaagagacactttctattgaaaaatcacttggaatgaaagagctgcaaattattccttatcaagaaggtgtcattgaacaagcagtgacggaggaaatggctggtcagttttgcctgaatgatgaccaattagtagaaatcacgcaaatcaccaaacaagtagaagcactttatggccatagcgtggatatcgaatttggaatagcaaatggcacattttatttactccaagccagaccgattaccgcagccctctcaaaagcagcagatgaaacagcgggtgcttcttttcaaatgcagtcagacgagctgcaggatttctggatctcaatggacgatcatatgccgggcccaacaagtcctctcttttcaagtctgatcatcccagcattaaaaagcgggatgaagaaaaacggtgaaaaatatcaagtgcctgatctgaatattaaagatatcaagctttatagaggccacctgtattcatcaccgtcacttcctgaagcgagtgcagaagctgcaccagtattcgatgagagtatatttgagttatttccgcatttaagtgaacgtatgtatgagattttagagaaaaatttctttcccttttacgaaaaactcgatcataaaatgaaggaaccgatgaccattgaagaagccatcatcggctttgaagaattaaagactttttatatacaagcatatgatgatcattttgatattgtcatacctcaagtcattttatcggctatgatagaagacatgcttgtgacgtatactggtgatcaatcacaagtgatcttgctgcatgagatgatgataggcgtgatgaacaaatctcttgaaacagacaaaaagctatctgattttgcaaagagtgtccttcaagataatgaacttcatcaagcatttatgaaccatgaaaagaacccagagctgcttgatgcactcactcaatcggaaaaaggcagacacttcatttcgacaataaaggaatttcttcaagtctatggctggagatctgttaaaagtcatgaccttacggaagagacatgggtggaaaaccctgagtttatactagatatcattagaaacaacattcaacaccaaagtgattttgatgaagaatttgcacaagccgtcatcaaaagacaagagacatatggacattttatgagcccagtgaaggatgaagcgtttaaaacgaaatttgagacactttaccaatttgctctacaggctactaatatccgtgacgatcatcacttctacattgatgccatgttagatgctaaagctagggtatacctattaaagattggtgaacttcttgtacaaaaaggagcgattcctcatcaagaagatctatggtacctctacgatgaggaggtacacacagctctcacaacgtctacaacatttaatacagtcatcgcacaaagaaaaattgacatgaaagataatgaagccatccaaccaccagcttatatgggcaccccaactgaagctgaattgcagcaagtagaaagaatgctcggttcattaagagaaaatgaaaacaacacaagcgatgtgatctatggaattggtgcatctagcggtattgtttctggaagagtaaaagtcattacatgtgctgaggaattctcacaatttcaaaaggatgatattttagtttgcaaaacaaccacacctttatggacgagcttatttagagatgcaaaagcagtcatcaccgatgctggaggcattttgtctcattcagctattatcgctagagaatatatgatgccagctgtcctaggaacccgaatagcgactgaaacacttcaatccggtgaccttgtgacagtagatgggagcaatggacgcattcagatattaaaacagcatgcacgtgtctaactttatcgttttggatcatattggcggtcataggttttatcggtatacttactttgttgcaaacacattcataacctgaggtgagtatgcttgttaaaatctacaaatcaacgaatcattcgcgcaacaatggatttattgactgaaaagggctatcaaaaaaccacaaccaaagaaatagccgcaaaagcgaatgtcagtgaagcaacaattttccgcaactttaaaaacaaacgcggagttattgctgccattatgaaaatgaaatcaacaccgacgaaaaccttagaagcagaattcaaaggcgatttatacaccgatttaaagtttctcggctcctatttccttgaggatttaacttcaaaaaaagaatttatttatatcagcatgcgagaaccggctatgtttaaagatctgaccagtcatgaaaaagtttatcctcaagaactaagagaaatgctgatacaatacttcaaaaagatgagcgctcagcatcatgtcttaaaaggaaaagaagacatttatgcagacattttcattagtacgtattttggtttttttattcagcagctagagcaagacttccagctcgtattaacacaaaaagatgattttattgagacatacacacacattttcatgagaggaatttctcccgcttaaagggtggaattcttcttttttacaaaaggtggtatacacattgaaattgcaaaaagagagtttgatcatctattctttgttactaggagctatactagttccggtcaactcaacgatgatcgcagtcgctttatcatccatatcaacttattatgatcaatccatttcaaacattacttgggttgtcacgatttatcttattgtcatggcggtcacccagcctatcgctggtaagttgggagatatatatgggcatcgccgtatgtatttaaccggagtgacactctttttaatcggctcgattggctgtgctttagcacctaatctagcatttctcatcatctttcgctccattcaagcagctggtggggccatattaacaccgaatagcattgctttgattcgtgcaacagtctcaccagaaaagctatctaaaacaatgggttactttggatttggtgctggtattggtgccgcacttgggccttttattggatcaattctcattcagagttttgattggcattccatattcttagtgaatatcccattcctatttcttacactagtcaccggtgttttacttattccaaagataaagcatacacgtatacatgcaagagtagatatgatcggttcattgtatttaaccatcggaattgccacagtcattctatgctcaaaaagccagctactaaatgaatatttaatttatggcattctagcattgattgtcattcctttattttttagacatgtacggaaagtaaagaatccgatcatcgatttgtccctatttaaaaacagttcatttacaaatgcgaatctgtcgatcatgctaagtaattttgtgatgtatgccatccttctcatcatgccactgtttatggaacaacaacttgccctttctcatacacaaagcggtatgattctatcggtattttctctttgtatgtctcttagcggtttattaggcgcaagactccatccaaaaaagggcgcgaaaaaaatgattcgcttttcatttctctgccttactttatcaggcatcatgttaattgcactgagtcagtacccaaccttacctctgcttatcgtgacactagtcgcaggtggaatttcatcagggattggtatgacaagtatgcagatggcttctttaacagctgttgatcaaagtttatctggttcggcctctggtattttctcaacctttcgatactttggcagtatcatttcgtcgacattgattggtatcatgagtggtttccaatctttatttattgtattaatgggcgcaggaatccttggcttccttttatcccaacgcgtcaaaacgaaatctacctccccatcatctgggcattctgcctaatgactccctgcgctctatgtcgatttagagcgggggagtttttattatttttatcactgtaagctataacaggcacaggaatcaaatattgaaaatccttttttaaagaggaaaaaaaccatatgactagacaaaaaaggaactttaaatcgaattgtcctcattcatccacctaaaatctgtttttcatctctttcagtattgataacttcgattttttttcacaatttttgtggtatgctttttgaaaatagaggacacaaaggagcggaagaatggaacgtgtaaaatatgttttgatctatttatcagctctattgttattcctgtcaggctgtggaaaagaccagcaatttactccacctggcagctctcaatcgatcgcggtcatctctcaattaaaaaaagcctccttttcaatagttgatttacaaaagaataaaatgatctcttccgttgatttaaaacatccgctcactgatcttatccaaatcaacaaagacgtcatcatcgcaactagtaaagaaggagaatcgctgatcgaaattaatttaaaaaaaggtacagcaacagattatatggatgtgaataaagggctgacttcccttacatatgatgcagcttctcacaccttaattgcagcggattcacagaaaagtgtcgtttattttattgatacgcagcgtaaaaaaataaaagcaactgtaaagaccggaaagttaccttcttctatgacactttctccgtcaggtactttatttgttttaaatgcagaaagtcatagtgtctctgtcatagatattgagaaggaaaaacatatacgtacgttctctgtacttgaacgaccttctggtattcattttgatggacaatccatttggatcggtggtcacggtaaaccaggcaccttaaataaaagcatttttgcttacgaccctaaaacaggtaaaaagcagcgagaaataaaactaggcgttatgcctgttgcattcttttcagagaaaaactcttctactttatatgtactttgtcatggagatcatacgctatacaaagtagatacagagacgaataagcagcttgcttctgttgaaactggtcaaaatccgaattatatcaccgctgataccacatcaatatatgtgagtaacttagatgacaattcagtatcaattatcgataaacatacattcatgatgaaaaatcgactgaatgtctcatcaggaccttatgctatcgtgttggaggaaaagaaatgaaagaacaaatgcatattttaatcgtagacgatgagttcgatatgcttgagttaatcggatccttcttaaaaagacaaggctttcacatcatcacagctaataatggaatggatgccttacgtcagcttgaaaaggaacccgttgaccttgtagtactagatatcatgatgcctgacatggatggatttgaagtctgccagcgtattcggcaaacatctcaaatccccatcttattcttaacagctagaagttatgaggaggatcgaattagaggtttagaaattggtgcggatgactacatcatgaagcctttcagtctacgtgagcttgcagcaagaattgaaacaactttgagacgaattagaggtctttcgctaaagcgcagccgcatacagtttgatgacatggagattgatcaggatggtagacaagtctatatccatcaggagcccattaatttaactagaagagaattcgatttgctcatgtttcttttactcaatcaaggccaagtgttttcacgagaacagctctatcaaaaactgtgggaatcacattctacgagcggatctttacgaacagtcgatacacatatcaaaacgctgagactgaaattaaagggagcggaacggcatataaaaaccgtttggggtgtcggctataagtttgaggaggaagaatgaagcctttatctattaaaaagaaggtgctcttcttaatccttgtagtgaccggaatcgttgctgcctcagctcttgccctcacctattacttataccagcacttatatgttgataaacagattgattccttaagtttacaaggtaaaaagctggcacaaatctatcataaacacgggaaagatacgtattttaccgatagaataaaatgggctaacgactcgagtcaggcgaacattatttttacagatgatccaatggagctttccagtggccttccttttgatacgaacacaaatgataacctcatcacgttcaaggaacgccaaaagctccttcaaggggatactgtcgtgttgattagagaacactctcagtttcatcaagatattcttggcatcgccatccctgttttctcaaacaaagatgagctatcagggacaatttttctatccatgcccttatcggatgtatatgaaccctttgtccaaatcagattgacacttggcatatctattttattaatcctgctcctgattttctttatcggatataaaagctccaataaagtcgttcggacaattaatcagatgaaagaaattgctatggaaatggaatctggtgatttttcaaaacggatggctgtgaccaaaaacggagatgagttaaaccaactgagccgctcttttaacaaactgtcttctacccttgaaaaagttgagcagcaccgcagggaatttcttgcgaatgtctctcacgaacttcggactccgctaagttatatgaaaggatatgctgaaggtattgaagaagggatcattgatcaaaaaaaaggaatgcacatcatccaggatgaggccgcacgtttaagccggcttgtgcatgatcttttagaccttgcgcagctagaaggagattcttatcccctaacgatggagccaatcgtctttgctcagctgattcatgacgttcttgatcaaatggcatttatcgctaatcaaaagggcatttatctgaaacggacacttgatgaagattgtattgtgtttggcgatagcgatcggctgcaacaagtgattcgtaatttactggataacgccattcattacactccctctggaaaatcggtctcgattgaattactagttcaccaacataaagctgaattgagagtgacagatgagggcaacggtattccaaaagaagaccttccacatgtttctgagcggttttaccgagtaaataaggcgcgtacgagaaaagatggcggctcaggccttggactagctattgtttatcaaatcatgaaaaaacatcatggcacgttcgatattcaatctgagacaggatgcggttcgacagccatcatccagctgccaaatactccaatcgatgaagacctgcctacgatataaccaaatagactttgtaagtaaggtcatccgtttaatccatatatacgcatcagtcgcctaaatttgaacagctattttcagcccctttttgatcatctgcttttatgtatcaatttctttcaaaaggtgactcggtactttagttcaaacaataaaactacattaaaaaagcgtgcgagaccttcttcaaaagtcctgcacgcttttaaattaaacagctgtttcaaaccgctttctattgatgaagaaagaaagcgtgatgatgagatagatacccattgtgaccatggtttggacaattggagtcgttgatactacaccgataaaaatggcaatgatcgcaatgacagaaaaccatgtcgtgaaaggatacagtttgacccgatatccttctggtgctgctacacttcgagactttaaatgcccgacagcaataataaaccagatgaataggactgtataacttaaagatcccattaaataattaaaggtttgacttcctacaaaaagagagattaatacagctgcatacaaagtagatgtacatactagaatcgctctgactggcacctgctgtttcgacagcttcgaaaagcccttccatacacggccatccattgcctgtgtaaatagtacccttgaagaagcatacagaccagagttcatagaagacaagatcgctaataaaataatcccgttcatgatatcacttgcatatggcacaccaatcgttgcaaacactgtgacgaatgggctcacttgttcattgtttacttgattccaaggaattaagctgacgatgatgaagaacggaagtacataaaaaccgatgattcgtacaaatgtactttgaatggcttttgggatgactttttcagggtttttcgtttctgctaatgtaaccccaatcatttcagttccgccatatgaatacacgaccaccagcattgccgcaattaagccgcccgttccatttgggaaaaatcctccgtggtcggttaagttggataatcccggtgctgcatgctgtccgaatgagacaaacagcatcgttaacccgatgataataaataaaagaatgacagcaattttaatagaagctaaccagtactctgtctcagcaaacattttgactgaacaaacattgatcaatgtcacaacaagtgaaatgattaacacaagtgtccaaatcggtacttgtgggaaccagtactgaataaagatggcagacacgatcgcttctgctgcaatgttcaacacccacattttccaatagatccagtctaagaaataggcggggtatttgcctaacacaggttcaattaaatcacggaatgttctagcgccaggtcgtgcaactgtcatttcggcaagtccttgcataataaataataaaataagaccaccaatcatatatgccaaaatgacagcaggacctgcgatatcaatggcagaactgcttcctttaaacagaccagcaccgatggctcctccaagtgcgagcatcatgatatgccttgacgtcattgttcgttttaactgtacatgttccttttccattttctatagctcctttaaattcgaatcttcagacaaatacaagataaaagcatataaaaaaggccagtcatctccttgaagagacgactgacctttcaaccgcgttaccactcttattgactcagacatagctgaatccaacttgaaacccgataacggaggtcacacgtaaagacttactattcattcggtcttaccgctccttgagcgagttcaatgattcgttttactgcgttgcaccaacccgcagctctcttagaaaacggatattcatttactattctcaagtcaaagcgtttatagtcaatttgtctatttatcaaagattttattttttaaatatactgactaaccacgcaattgtcaacagcctttttccgacatttccttttaacgaatccaaacggctacttcatccattggacgacgcgtttttccgcgctttggctcaacgactcgatacccaaaggcagccatgacagagatgtcgtactgaccatcttcaagtaatccttcttcctcaagcatacgatgaatttcatcgtagctgaatccctcaacaggacatgaatcaatgccgatttgtgccgcagctgtcatcatatttccaagggcaatatacgtttgtttggaagcccaatcgaagagcgtacggtcagtttccatcaaatgaagatcattctcttggaattgtttgtagcgttcttttaccatctcaaacgtttcgtctgtcattcctttgatttccttattgatgtattctgcatatggtgaatcatacctggcgtctgttcttgccaaaatgatcacaaaatggctggcagttggcagctgcttttgcgcaccccatgtatattcttttaatttctctctaaatgcttcattttgaacgacgaggaacttccaaggctcaaatccgacagagcttggggaaagtcttcctgtctctaaaatgaacgcaaaatcatcttctggaatctttttcgccgggtcaaactcttttgtcgcatgacggaattcatacgcctcaatgatttctttttttaatcgctctttgtctcgcatggtattcatcctttctagtgaacggttagggtgtgaagtttcaccaatccaatttctttccattcccatatagaaattgttatgataagaaaacaaacaacccgatgtgtgatgtgatatctctatggtaaaagaaaagcttcctttgattcaagtacgcacatttttgttcgttaggtacaatcatgttcgtttatcacccatttcgtcttagaaaggagcgtaaagatgagtgcaccatccaacccagtcagtattgtcaatcatggctgtcccgtttcaaccacctcgagtgtaataggaggaaaatggaaaggagtgatcctttatcatttgacttgcggtccaaaacgatacaatgaattacgccggcttctgccaagaatttctcagcgtgttcttacgctgcaattgcgtgaactagaacaagacggcattgttcacagagaagtctatgaggaggtccctcctcgtgtcgaatattcactcacttctctaggagatacgttaaagcctattatcttcgctatgcgtgaatggggcgaatcctatggaaaagaagcgcgcccaaaagaaaaaagctgccatctctagcagctttttttatgatgaaatcgccgttgattcttgctgtggatcatcctttacaaacaggatgccaagctgatgatgctccccttcgtaagaagcgcgtttctcaaaccttgtctgaccattcaagccaatgatctcaagctttgtcagagcacgattggtttgaagggcttcgtaaaattccgaaacggttttgacttcaattccattcacctttgtaatgacttctccgatctcaagctttaaatcagctgcaggggtattcggaatgattcctagcaccattagcccctgattacgcttagagaagtagaatggagccgcattgtcgttgactcgctgtttccatgaaaggaaagctctaccggccatcgctattaatacagcaccccatgcaatcggctcaaaccaaatacttgcagcacctagtaaagcaacagcaagtcctagcatgagaatacgccgagctgtaatttgaatgctcacaattggcagcgatccttgaatccgctgcccgaaaccgatgatgtatggaatcaaaataaaagaaaagctttgatcgtgtacttgaagcaccggccaccatggcagagaagaagtaaattcacctgccggcatcagcaaaacaagcggtaaaagccacagacggtttgcccgctgctggccaatcaaaagtcctctcgcactcatcaccattgcaggcgatgttcgtaaatgcgccgttcgataggctagaatcccctcggtcattaataaaagacctagcagaatgacaacggctgatgcattcatcattgagagctgcggcagccatgaatggctcacttggacatacaatagtccaagtgccgcaataaaactgaaaccgagtgtgtatgcagacgaaagcgcactcgccttaaagaataaagagcaaacgatggtcatcgctgcaatcagcacgatgaatccaggcgggagggcaatccctaagcctactgaaataatggataggcaaattcctagaatccatccctttgaatatgtaaatttaagttcatcgtatacatcttctattcttgtttgaaacgcttttctctcccgctttacgcggatgtagccatgtaacaggctgattaatatcatgaaataaaaaagagggtggattaaaaacagaccgaccgcttttaatccagctcccatccactccgagctcattatcgttcaccgcccaagtcaagcattttctcttattctatcaaataaatcgatgcttgacaccaggtttatttctcctgattcatccaaagtgtgacattcgacagtgaaaaatcttttaagtagtgattgacatctacatctagtatgccgccgagcagctgcatcgacctcttgatgtcggttaagtttataccaagtctcttatgattatccattaaataattgaagtatatctcagcacagtcttcatcgatttcgtcgactgattctaccgttgtgtaattgaccaagtacctgctcaacagcatgagcagacttaatgcctttgtagcggaaaacgtcacatctttcgtacgactcttaagctcctctaccaactcgtaatattttttctctctcacaatacttgcccttttcaattgtgtacccccatttactagttcttttaagaaaagcgcaaacctcggtacagcttaatgctcaagctgaatatccgcaaaaaataaaatatttaaaatgagtgctactttatattgtaagaattatttatgtaacatacaactttcaaaagtttcattttcatgacatgtttaaatcaacagaaagtctcttatataaatatgttatcgggtaaaatcggaggaatgttatgttttttgtaaaataaatgaatatatttctcgatataatttatttttaagaataaactattacatgtttgtgacacttatgaaccaaaaaaaagaggcatttattcgcctctttattttttaagatatagtgcttttagtgcagtctgcagttgaagatcatttttttcataggatttcacttcatccaccattttgttcatcattttcgctgtcttcagatcaattacacctgatttattaagattgtatgtgctttggaaggctaataccgcctttttcgtttcttcatcaaagtagccatctactctgccggggtcgaatgacaagccctttaatagcgtctgtgcttgtctcacttcttcattgttcatatcaagctgaagaggttctttcagctgaagcggacctacagtaaagtaatctggctgatgaatcgcaatggtcggtacgacaccttttttgtgaatccaattcccttttggcgtgagccatttatacaacgttaatttaatgttactgccgtcacccattggaaccgcctgctgcacagtgcctttgccaaaggagacatcaccgacaacttcatattttccggcttctttcatagcacctgcaagtatttcagaagcggatgcactgcctttatcaattaagacattaactgggtaagacttctgttccttccgctttgaaaaatatcgtttcctgtcgccgttccgttctgcaatttgaatatatggctgatcctttgtaataaagtgctttaaaatgtcttctacactttgcagatagccgccagggtttcctctcacatcaagcacaaggccttctatgccctttttctcgagctgtttcaggcttgacgtgaaatccttcgcagtatcttctgaaaagcttgagatcgcgatatagcctgttttatgtccatttacctctttcacagaggaagtcacggtttcaagcgggatttcttctcgtttgatttggaaggttaactctttttcaatcccatttcgtctgattttcagagcgacggatgttccttttttccctcttatttttagtacagcatcgtttaagcttttttctttcatcgactcaccatcaatgctgatgatttcatctttcggctttaggcctgcttttgctgcgggggattttttaaaggcagagacgataatgatttttccttcatccatccccacttctgccccaattccctcaaaagaagaatcaagcgaatcagaaaattgcttggcagtttgcttgtccatgtatactgaatatggatcatttaaagttgaaagcattccttgaatagcgccttcaagcagcttttggcgatccacttcctctacatattcattcgaaataaggtcataggctttctcaattttctccatcccattctctttcgccttatcacttgattgagcttgtccagccattgcagcagctgcttgcggtgactccgcatgagttccctctttatgcgtcatcacccctgcactaattaatagaacgacacttgccataatagatgcgatttgttttttcatatttggcctccttcttcaactcttcctgatgacctgagttattatatgccagaagaagggatttcatgtaaagacattctgccgcgaaggcttgactaattattttattaggtgtaatttttattttgttatgatcgagaaggagtcttcgctatgtatattatattgacgatgctattattaggaattttattaggatttgtaggagcaggcggggctggttttgtcatcgcattgcttacgttaatttttgatatccctatccataccgcacttgggacgtctttagccgcaatggcatttacgacgttatcaggtgcatacagccactacagggaagggaatattcagctgaaatctggtttgattgtcggagctttggcttgtgtggcttcctttgcaggagctaagattgctccttttattccagaaggaaatctgcactatttaacagccggaatgctctttttatccgctgtgtttatgatgatcaaattatttgttctgaaggaagaagctgagcagcagccgctttcttcacgtcagctgcttataaggggtattattttaggacttgtatctggattgctgtcaggtatgtttggtatcgggtccgcaccatttatccaagtaggacttttgattttactgagactttccattcggcaggcagttggcacgacgatgcttgtcattattccgatttccatcggtggtggaattggatatattacagagggctatgttgattttatcttactcattcaaattttaatcggaacagtattaggggcttatattggcgcaaaattcacacgtcttgcaccgaagcttttattaaaatcggctgtactgctaacacctattattgccggtatactgctgttattttaattttatttagaataaaaaaagccgataacatgatgttatcggctttttgattagcggatatattgcgctgggttgactgcatttgatttagcaccattccataatcctttatgaatttcaaaatggagatgctgaccatgtgactggcctgtattccccatatatccaaggaattgtccttgctcgactctctgccctgtggacacacttcttgtagataggtgggcatataccgtttgataagtctgtccattgatattatgcgtaatgaatatcacgttcccgtagcttgatgagtagcttgagttcgtgactgttccagatgctgctgcgacgacagatactgtgccttttgctgcaatatctaatccaaagtggtttccgccagaacgcccgccaaagccagatgagaagcgtcctgcagctggtttaataaaacctgagctgcttgatggtgtatcagatacttgatctgagccgccactttgaggtgcaggtgcacttttttcagcagctgcttgttctgctttctttgcttcttccttttgtcggcgtgcttcctcagacttcacagccgctttttggttcgttagaatttcttgttcattttcgagtttgcctaattcatcatgggcatggttctttttatctgttacatcccctaagattttctctttttctttttgctgtttagacaaatcctttttcaactcttctagctctttcagagatgtttcaagtccacttagctgattatttagctctgcttctttttgctccaccagctttaaatcattttcatgttctgtaatcatgtctttgtctgcttcgacaatggttgtgacagctccaacacgaccgacaaaatcactaaagctgcgagcacccagcagcacatctaaatagttgatcgtaccgccgcttttttgcatcgaacgaattcgatctttgaaaatagcttttcttttttcaattcgatcattgatgacttgaatgtccttttttagtttcttgatctcttgcttcgtttgtttgacttctttttctttttctgccactttttcagttgcagcacttaccttatgatcaatcttttcaatttcttttttgagctttgattctttcttttcaagcttagccagctctgatttctttttcttcaaagttgattcagtctttgatgttttctcttcgatttgttgacgcttttgatctaggtcttcgtatgcgaatgcacgattctcattccctggaatatatagccacgttgttccaataaacgctgccattccagccatcatcagctttcttttcaaaacgatattcccctcctatgacaactgcctgcatgaagagtcgaccggatgaactggttcaaccggtcacaccttctatcaaattctcgagtgctgccatcaaaaatagatttatacttttaagaatttacggatggacgtcaagcttccccatacaccaatgattgcaccgatcaaaagaaggaccagtgacacttgataaacaaacgggttatatggaagcatggaaataaatgagccttgtactctcggtgccacccagcccactgcatattgatatgtgccaagtaatagagcaattggtataatggaaccaaatacaccgagcagtaatccttcaataaagaatggccagcggataaaccagttcgttgcacctacaagcttcataatctcgatttctttacgtctagcaaaaatcgtaattttgatcgtatttgagatcaagaacatggctgtaaataaaagcccaataataagcgcaatccctacatttcgcgccactccgaccacattaaagagtcggctgacttcttctttaccataggttactttatacgtaccttttaggttttctaatttcttcgcaacttttggtgtatcgtgtggatctgatgttttcacaataaacgcatcgtttaatgggttttcttgatcaacaagtcccatggattgtccattttcaccaaagcttttaatcagtgcttttagttcatcatccttggatgagtatttcacatcactgatttcaggaatcttctcaatttctgcttttaattcatcctgctgcttttgattcgcggttaaatcgattagaacttttacttctacttctttctcagcgttcgatgccatgttattcaagttgagcataatcacaagaaaaaccccaactaaaatcaatgtgacagtgaccgcactaattgatgcaaatgtcatccacgtgtttcttccaagtgaacggaagctctcacgtaaatgccgcgagagagttttaatcataaatgccgtactcccctcttgcttcgtcacgcacaatcattccatcttcgattgcgatgacgcgtttcttcatgctgtttacaatctctttgttatgtgttgccataacgactgttgttcctcggttattaatctcttcgagtgtcttcatgatttcccaagatgtgtctggatcaaggtttcctgtcggctcgtctgcaatgactacctcaggactattcacgatcgaacgagcgatggatacacgctgctgctcaccgccagacagctggtcaggaaattgtcgcgctttgtgcttgagctgtaccaaatcaagtacatccagcacttttttcttaatgatttgaggctgttccccaatgacttcgagagcaaatgccacgttctcaaacacagtgagagttgggagtagtttgaaatcttggaatactacgccaatttctcttcttaagtaaggtatttctttttccttaatcgagcctaaatctttgctattaattaagattttccctttggttggcttctcttcacgatacatcattttgatgaaagtggatttaccagcaccactgggaccaacaacatacacaaactctcctgggtggatagagacattgattccattgatcgcctttacaccgttaggatagatcttgtagacttccttcatttcaatcatgtaatcacctaatcttttcttatttctgactaacagcttatcatgatgttttgacagtaatcgtcaaaacacgttatgtatggtcacgcacatacccttcgatacgcacaagcaatttatgtccttttcatccaaaaagatgaaaaaattgaatcgtctaaatttcaacaactccaattatacgtcatgaatcgacgcaatggtattacatttatgtttcaaaacttatagttaaaaggtaaaaacaacatttaaaaccgaaaaacatgtctttttacccttattttttaaataaaatttaatataatacgttttcatactattcaaaagtctttttctacatataaaaacaaaaaaaccttgtcgattagacaaaggttttattttttctctgcaagccactttgctacttcttttgcttgcttctcatctaccattccgcttggcatagagcctttaccattctgtgcaatatctgcaatttggctttcattatatttcttccctacttctttcaggcttggtccgcctccgccagataggtctttcccatgacagccaatacagttttgctgataaatttcctcaccactgctcacagttgaagcacttttgctgccttcttttttactgtcactgctgcttgaatttcctccacaagccgcaagaacaagaagcatcgctgcaaacagcatcattaatccgctcttttgcatcaatttccctcccctacaatcatttggtcaacgctattatatccttgtttacgcccttttaaaaccctcaccaagcacctcttttgcatccattacgatgacaaatgctgatgcatcgattgctttcaccacttgtttcaactttgtgaattgtgactgcccaacgacacacatcaaaattggacggtcatggtcagtatatcctccgactgctgagatttttgtgacaccacggtcaatttgatcaaacactgcctgtctaacttcatcctcatgccctgtaatgatcatcgccattttcgaatgactgaatccggcctgtacgacatcaatcgttttacttgaaataaatacaccaatgacagcgtacagtccctcttcaatcccgaaaacagtcatcgcagccaatacaattaggccatccatcatcgctagacaagtgccaagcgtgaggcctgtatatttattgatgattttggcagcgagtgccgttccacctgttgacccatttccaaggaacacgagccctattccgatcccaatcactactccgccaaaaatggctgctaagagcgcttcatgtgtcactggtgcaatatgtcttgtgacaaacaccatcaaaggtaagaaaatagagccaacgagcgttttcactccgaatgtaccgcctaataaataaaaaccagcgataaacagcggaatattgagcccccactgcacatatgccgcctcaaagccgaatgactgcataatcgtactaataccgctcacaccacctgcggcaatctgattcggtaataataacgtattaaatccaatcgccacaatggctgatccaattaaaatgaacaagtaatttttcgcttcaatccataattgtgaatgtccctgcttcatgtctttcttcctccgttacttctgaatgcacacctattttaagccctcctattacgaatgtaaataacagccaaatgcagtgctaatggattaatactttatcacacaaacggaccagcgtacttgccgtttggtataggagcaaatgatggtatatttaatatgtacatgagaaagaagggacatgcgatgaagaaaatactgaagatcacaggcattacattacttgcactgatcattttggcttttggtgctttctatacatggagccgctttacatacggaccatctgccgcattaaaaaagcaagtaaacatcgagcaagtagaacttaaaaacgacgtatatacatttgcttcaacaaaaagcgatacaggcatcattttctatccaggagcaaaggtagaaccactttcgtacgcctatatcgggaatgaattgatgaaaaaaggctattctgtctttatccctgacatgccattttcgtttgcgatttttcatacaaataaagctcaagatatcatgaaggatcatcaaacgatcaaacactggtatattggcggacattcacttggcggaacagctgccgctatgtttgcagaaaaaaaccagcgcaagctcgacggtctttttttcctcgcatcttatccagcatcagatgagctcgaatcatcgtccttgaacatcctctctatatcaggtgaaaaggatggacttgcgacacaagagaaaatcatgaagtcgaaaacaaatctgccgtctcaaaccgtttatcatgaaataaaaggcgggaaccatgctcagtttggcatgtacggtaaacaaaaaggtgaccagccagcggacattccagccctcacacagcaaaaggagatcattcagacgatgcttaaatggctaaaaccagcaaaaaagctcccgtaatgggagcttttcatttttactttttcgtcgcttctaaaaactcttcagcgtctgctacagcgaggctaatggcttcctcccaaaagtctttttgggtaagatcgacacctaagtgcttaaaggccaaatcttctactgccattgatgctgtgtcctttagtaatgcaatatatttttcttcaaacgaagtaccagcctgcaaggcttttgcataaattcctagtgagaacatgtagccaaacgtgtacgggaaattataaaacggtacacccgtgatatggaaatgcagcttagacgcccagaaatgcggatggtattcatctaatgagtcaccaaaggcttctttctgcgcttctaccatcagctcattcaaccggtccgccggcacttctccttgtttacgctcttcataaaagcgctgttcaaacaagaaacgagattgaatgttcatgaaaaatgcgacactccgctgcagcttatcctctaacaagctgaggcgctcctcttcatttgccgcttcttttaaagaagcatcagccacaatcatttctgcgaatgtcgacgccgtttcagctacattcatcgcatatttgcgattaagaatgcgaacatcctgcatcacttcctgatggaacgaatgaccaagctcatgcgcaagtgttgccacattggatggactgcctgagaaggtcataaaaatgcgcgactctccgctgtcagggaaatttgtacaaaaaccgcctactcgtttgttcgggcgatcctcagcttctacccagcgctcattaaaggccttttctgtaaaagcagcaagctcttctccaaagccagcgaaatgtttcacaataaaagtagctgcttcctggtacggatagatcttggtctcactgccaataggagccccaacatcaaaccagcttagcttatccactccaagcatgtcagcctttcgatgtaagtaatcaatgaatggctgtttatgttcatcaatcacagaccacatagcatcaagggtttcttgtttcatccggcaaatatcaagcggctcttttaaaatatgatcccagcctcttgcttcatatacttgcagacgaaaacctgccagatgattgagcgtgcttgcaaatagatgttcgtcctgcgtccatgcatgctctaggttatggtaaacagcctttctgacttcacggtctgaatcatccatcgcattttccgcttggccaacagagatcatctgcgtttcaccatgttgttcaaacggaatcgtaatcttatttaccaagctagaataaagctcatcccacgcatggtagccatctacggctagcttttgaatcaatgtttcttgctcaacaggcaattgatccttcacgcgctctctgcgttcatttaatatgtagcgaacatctgaaaaggcctctgaattcatgagatcttcccattttccaggagagatggccgcgagcgcctgatcaaacagcgcaagaatggtacctaaatcagcttccagcttagcaatcgtacttcgaagactaccagctttcatatcctttgtattttgcgattgaagacaggatacaaatgaacctgcttgagacagttttttatatgtggtttcatacgtgtcaaggacagacgttaacctattttcaatgtgtgtatcttcatttgaaaaggcatcgaccttttgtcgtaattcatctaatagctgctcaatgtgttgcaagtatgttttaaattctggtgaagagctgcctcctttaaaaaaggcatctaaatcccacgtctcttgtaatcgtgttaatcccaaaatatttccccctttatttgctaatttcatcatacaaaggatatagagtcagtatggcgtatgtattcctttatattcattatattttctcacaataaaaaaaacccggcaagaagccgagtttttatgataatttcgaacgtaagtaagcgtcgataaatgaatctaaatctccatccatgaccgcttgaacatttcccatctccgtattggttcgatggtctttcacaagagaatacggatggaatacataagagcgaatttggcttccccagccaatttctttctgctctcctctaatttcatccaattcagcctgctgttcttcgatccgtctttgataaagtttcgatttcagcattttcatcgcacgatctctgtttttgatttgtgatctttctgtttggcatgtcaccacggcattcgttggaatgtgtgtaatacgaacggcagagtcagtcgtattgacgtgctgtccacctgcgccgcttgcacgatacgtatctactttgatatcttctgttcgaatatcaatatcaatttcttcattgaactcaggcatgacatcacaggaaacgaaagacgtatgcctgcggccagatgaatcaaaaggagaaatacgaaccaaacgatggacgcctttttctgcttttaagtacccgtatgcgttatgccctttgatgagcaatgtcacagacttaattcctgcttcatcaccaggaagataatcgagtgtttcaaccttaaagcctctgcgctctgcccagcgagtatacattctcagaagcatagaaccccagtcctgtgattcagtaccgcctgcgcctgggtgaagctcgaggatggcattgtttttatcatatggttcacttaagagaagctgcagttcaaactcgttaaattgcttggttaaattcttcagctctttctcaagctctacatgaagctcctcgtcataatcttcctttaataggtcatgtgtcatttgcagctcttcatgagattcactgagctcatggtatgaattcacattatcctttagtgcattggcttcattgatgacgccttgtgccttttgctgatcattccaaaaatcagcctctgacattgtcgcttcgagttctgcaattttggcttcttttgtttcgaggtcaaagagaccccctaaaatcagctagcctgctagccatattttcaagctcttgtctaatttctactaattccatatccttcacctcatagatgtatgggggctgacatgaatagaaagaggttttcacctctttctattacttattctgtcttcccatgacaatttttatatttcttgccgcttccgcagtgacatggtgagtttcgaccaatgtctacgactttacgtaccggcttctttttcactgtcttctcctcatcaccctcttgaggctgatgagctgttgtttgaccttgaacgacttcttcgcgttctaagttgttttggatttctgatttcaagacatatttggccacatcatcttcgattgaagcgaccatatgctcaaacatcgcaaatccttccatttgatactcacgaagcggatttgtttgtgcatacgcacgtaaatgaatcccttgacgcagttgatccattgcatcgatatgatccatccactttgaatccaccgcacgaagaacgatgactttttcaaattctcgcatttgttcatcgccatatgtttcttcttttgcatcgtatttttctttaatacgatccataatgaaggaggtgatttcatctgcttctttaccgtaaatgtccttaaccgaaatggctccttcatctaaatagttcgtgttgattaattcaacaagcccatctagtttccattcttcaggaagctcttctttcggcgtataagaaccaacagcgcgctcaattgaagactgaatcatattgatcacaatcgattttaagttatcagaatcaatgacttcaaagcgctgcttgtaaatcacttcacgctgctgacgaagtacatcgtcatattgcagaagctgtttacgtgaatcaaagttgttcccctcaacgcgtttttgagatgattcaacggctttagacaccattttactttggataggtgtagtgtcatccatgccaaagcggtcaagcattgccatcgtgcgctctgcaccaaatcggcgcatcaattcatcttccatagagagatagaattgggtaatccctgggtctccttgacgaccagaacgtccacgcagctggttatcaatacgtcgtgattcatgacgctctgtcccaattacagctagaccgccaagctctttgacgccttcgccaagcttgatgtccgtaccacgtcctgccatgttggttgcaatggtgacggcacccttttgaccagcctcttcaataatttgtgcctcacgctcatggtttttcgcatttaacacttgatgaggaatccctttatttttaagcagcttagaaataagctcagacgtctcaaccgctactgttccgacaagcactggctgccctgtcatatagcgctgcgcaacatcttcagccactgctttaaatttaccttccattgtgcggtaaattaaatcaggtctgtcatcacgaaccactggttgattggtcgggattgtcacaacctgcatgttgtaaatgttacggaattcttcttcttccgttttcgctgtaccggtcataccagaaagcttttcatacatgcggaagtagttctggaatgtaatcgttgcaagggtcatactttcgttctgcacttcgagaccttcttttgcctcaatggcttgatgcagaccttcactataacggcgtcctttcatgagacgtcctgtgaaagagtcaacaataacgacttgaccttcttcaacgacataatccacatctttttgcatcgcaacatgtgcctttagcgcctgggcgatgtgatggttcaatgcgacatgtttaacatcgaataagttttcgatgccgaatgctttttctgctttcgtcattccgctttctgtcagctgaacactttttgttttaatatcgtatgtgaaatcatcttctatttttagtgtacgaacaaatgcattcgcttgtacgtaaagctttgtagatttcgcagcttgtccagaaataataagaggtgttctcgcttcatcaattaagatggagtcaacctcatcaatcacggcataatgaagcggtctttgaaccatttgctctttgtaaagaaccatgttatcccgtaaatagtcaaagccaagttcgttgtttgtggaatacgtaatatcagcggcatacgcttctcttttttcatctttgtctaagctgtttaagtttaagccaaccgttaagccaagaaattcaaaaatcttgcccatttcctctgcatcacgacttgccaaatattcgttgactgtcacaatgtggacgccttttccagaaagagcatttaaataaacaggcattgttgaagtcaacgttttaccttcacctgttttcatctcagagatgttgccttcatgaagcgcgatcccccccatgagctgcaccttaaatgggaacattcctgtcacgcggcgtgatgcctcgcgaaccgttgcaaatgcttcaaccaacaggtcatccacggattgtcctttttcaagtttttctttaaattcgatcgttttatttcgtaaagcctcgtcagataatttctcgaaatcttgagcgagagcttcaatttcatttgcttttttttcatatttgctgatcgtacgtttcgtaggatcaaacactttgtttaagattccaagcatataataacgctcctctatttcatgcaatttttcggcatgtccaaaagattgacaggtccatatttacctgcatttatcataccataccttccttcatttccaaagaatttgcaatgatttcgcacaaaaaacccgcccctcatagagggaacgggtttactttttttaggttatttttagatcagattaagcgtttggctcaatgagtccatattttccatcatttcggcgatagaccacattggtcaaatttgtctcagcatttgtgaagacgaagaaactatgacctaacatgttcatttgaagaatggcctcttcgctatccatcggttttaaattgaaacgtttttgtctgacgatttctgtttcatcaatttcttcgtcatcttgaacagctacatcagccgtcccatttcctccagcaaataagtgctttttggcaccttgctcgcggaatttacggtttacttttgttttgtgcttacgaatttgacgttctaatttactggctgctaggtctactgcattgtacatatcttcattatgcacctcagctcgaagtgctagatcagtcattggaatggtaacctcaactttagattcttgatcattgtaaaacttcaagttcacgttgactgaagcatctacgtctgtctcaaaataacgctccagctttccaatttttttctcgacatgatctcttagtgcaggtgttacatcgatgttttctcctctgacattgtaattcatgtaaagaacgcctcctttaaaattaaggatatgtaaacctatttctacttttccctccttttctcctgctcaaacgtaaaaaaaatgtgaatatttattgaaatttgtcgaattttgcggtgcttcaactgttgcttgataggtgatgaatatatattcggctcattcttgaaaaagaccaacacacatttaaatggtgaaagatgatattgatgttttcagcgattgagataaggtttttaagtcttctgccgctgctttcatttcttcattagctgccaatgattcttcaacagccgcagacatgtactccgtctcttctgaattgcgtttggctccttcttcaatgaccccaaccgtctgagatatttcctctgtactagctgaaatctcctcagcagtggctgaaagttcctctgctttcatcgaaatatcacgaatagattccaggatttcatgaaaactctgttctgacaattgcgatactttcacaccttctgctacatcctgctcaacctttgtcatcgtatgtgatgatttttcagtatctttgttcacgttcgcgagcaattgactaatttgatctgtcagctgactagattcttccgccagtttcctcacttcatctgctactaccgcaaagcctctcccattctctcccgctcttgccgcttcaatagcagcatttaaagcaagcaaattcgtttgatcagcgattgcatggatatgacttaacaaatcttcaatgccagtaaactgggcttgtacatgagccattgtggaatggtgctcgttcacagacgctttgatagagctcatttgttttacgaattgctgaataagcgctgcaccctcttcagccttttcagtcactgaaattgagtgacccgaaacatcggatgtgtgctcagctgcattttgcataccagtcgagacttcttgaatggcagaagctacttttccgaccgcctctgattgttcacgtgaagcttcactcacctgttcaatcgagctagatgtctgctcactggccgatatggtttgatgaatcgtttcctcaaactgagcagcagaatcagctaattgtcttgatccttgttgcacctgtaaaatgagctgacgcaaatgctttgtcatttgattaaaagcggtaccgagctgcccaatctcatttttagaggtcacttcaatctcttcaagtgtaaggtcaccatctgccatccttcttgcagcatttgtgacagacacaatcggctttgtcatacgataaacgaatcttgtcccaatcaacaaaaagccaacaataatgactgcactaactagaatgagagtgaatagtaattgattactgtcttggttgagctgattgattttttggtcacgctgctttaactgggtttgagcaaattcttttgtaaaggtatgtatttcttgttcgataggttgtaattcttgattgaggcgtgtgttgaattctttttgattttgcatattcaatgaattaaatagtcggttcgttgaggtgtagtagagataattcttttctgagatttgatctaatagattttttgcttgtttgacagtgctcatgtttgcagcttccgttgttttcttattaatctcttcatatgtttgctcaattttctgtaaatttccagcatcttgcatgacaacataggttttgatttgcgcttcctgtttttgcaaaagcgcctctaattccagtgaggtctgataaagcttcacttctttattgagaagcgtcttgtaggattgatctgttttgtaatagataaagcttgagaatcctaaaatactgacaaacaatacacatatgacaataagcccaaataaaaattgattttttagtctcataatttcctccgaaagtctgaattgaacaaaaattaatgaatgacatacggcctcatacaggcatgtatttcatccatccactttctatattcaggtataaaatatgatgtaaggaatgattggaagtgtattgaagggaatgtatagaaagctagtatatcaaaacttaaaaaaatttgatcaaacgaacgaatcgttttggcaaagtgctcattttctataattgaaagcagaaggggatgagttgtctctaaatgaaagaaggcatggatcagatcattaaagatccgatccccttcagttttagcaaaatccttctcaatttcatctaaatattttagactctcttctatcgtaaatagaagttcataatatgtggttaataaaatatagtcatctgaacgatacgccacaggtctcacctaattatttccgtttatcgtaatatacgccgtcactcgtcataggctggtatggattttgataattcagctgtttcgttttctttttttgaatggcttgaatatctgctttgatcccattttggatcacagttaattgctttgccatctgttgatctgtttggataatttctttgattttttctttttcttgatctgtcagctcatgctgaatctctctcattaattcgtctctctcaattaaaaaggcatcaaagtcttcaactaaggtgtcactttgcggatttgacgttatttcggctgccatttttaatgtttggtcatgcagctggtccacaatactcatagagatcctccaatagagtggtggcgcccttttcgatcggtttgaataacttccttccacgcatcacgaaaatcagttacgtattgctctacttcattcaacatctcttcgtcattttgaagattggcttcaatcagtctgcgataaatgtaatcatacatacttgccatactctttgatacgtcataagaacgatttaaggtgacatttaattcttgaatgatgttttgagccttcttcaggttcacatttctcgtttctgcatcctctttttgaatggcatacttcgctaatctaatgaactttaagcagccttcataaagcataagcgtcaactcggcaggtgttgcagtctcaatagaatttttctgataggcggcataagggttctgaattgccatatgttataaacctccaattattgtccaagcagttgagaaagatagccagattggttgtttagcttttgaatcgcgctatccatggcgttaaactttttgtagtaacgggcttcaacaagtttcaaacggtcttggaatgtatccattcgttttgttaaagaatcaaggtccttacccagtccgtattcctttaattccattgttgtgctgccagccttcgtttggatgctcttcgtgaaggctgataaggaatttttgacacgatgaatgattccttgttcattatattgctgctgcgctttgtctttgtctttagaatccacgtttaatgaacctgagataaacatttgactgatcttctgcggatcttcttcaatggcttttcttaatttttcttcattaatttcaagcttcccgccatctttatatttatttgaagtggtaattccgatttgtgtgatatgaattttatttgcatcacttgtcgtaatatcagcataaaaatcacttcttattttagaggcaccgcctcgtaaaatggaatcacttctcagcaagccagacttcgctgtcgtttcccatagctccacttctttgtcagacattgcttttttctcttctgctgttaaaggatgatagtccctatttcttttttcattgactttgccattgacctgctcaacaagttcattgtatttatcaacaaattgtttaattttatcaaagattgtatcgacatctgttgaaacgtttaagctgacaggcttatctgttgttccttttagctcgtacgtaataccagcctgcgtgaatgtattattgttattttccattttgagaccattaatttcatattgcgctttctgcccttgagtggtcgcaactaatttgttatctccatccacttggaatcctaattgcgttaaaaatgatgcagaattgccatccgtagccttaatactgacaccttcaccagtcgtacgtgaagtcagagcaatcgtatccacgtagtttgttccatcaaaaatttggcctttataagccgtgacacctagttgggagttgttcaattttgacatgattgaatcaagggtatctgtatcagtagtattaatggtcactgttttgggtgtcgtagaatctggtgtcgtcacctcaaacgtaaatgtaccgtttgcagcagtaaatccagatgtaccagaagatttgaatacagaagctgtcgctagttgggtcacattaatcgagccagaggtagcatttgttgatccggttgctgtgacagcagattcgtttgagcttgtgaccttttttgcgccataagtacttggatatgttaaatttagtttggaaatgagatcatctaattctttgacctttgaattgacctcacgataactgtctctttgccattcaagtgtttgtttctggcgtgtcattttatcaagtggtgcttgttctgttttcatgagttttgatacgatttcatcaatatcaaacacattcgaaaatcccgtaattcgattaaccattgtttatgttctcccttcaattacattcttttatctacaaataaaccgacaatttctgtcatcgccgcatagaaatcaagccattccttggaaggaatctctctaatgacttcttctgtttggttatctacgactttgacataatattcattgagtttttcatgtaattcaaattgcagatgaaattgcgtaggctcaatgagcttgtttgccccttgaagcgttttttcaatttcttcttttgaaacgaccttgccatttgcttgtgagtcagagtttacattgtcattctgtttattagaaacacgggtttgaaatgcatcaataattggctctagcgaagtcaatttaccaacagacatagttattcagctcctgtgctttaatctatcttttatatcggctttgaatttgcaaattaaatatagatggaccgatttgttaaagtttcctatagatcatgaacatctgtattgatacgctttcacacggagaaggacaactgaatgcgataaaaaaatcctcactttttttgtgaggataattgagagaggagatctaaagataaactcgcagcacgactgttctcttcttgaatagacaggtacacttctttcctgtgaatatcaatgtgcttaggagcttcaatcccgattttcacttgatcaccttcgattgaaataatcttaacttcaatatcatcgcctatttgaatcgactggtttaatttacgagatagaactaacatgaggatgccacctctaacaaatgttttgtatgataggctgaatcatgcaaaattacctgcttggctttcatgtttttgcggttcacaataataggcgctcttaaattggctgtcgttttttcaatagaagattccattgttaagatcaccatgacttccacttcattcgcatcttctacttctagaatatctacgaccgtttcgtctagatcgaattcatattgattgaaaaataaaaacggactgctgacaataaagcctaactctgcgtttttcaatgattgaagaactaaaaatggagactcgtctgataaaggtaaaatgacaaactgtttttgatccagaaatcctggtattccattagagaagttgataatttgctcctctttgattgtcacttcaccatggtattttgtttgaatgatcataattcacgacctttttctttttcttaactataccttatcaccattttggcccgtttcgtcaacttctatttttaaatctggatattgtaacatatcaatattgaccttacctggctgatagttaacgattggtttatgaggcgttgcctctatgatagctttttgaggctccacatcaatttgaagctcagatggctgatagtgaattttcacactaaagaatgaagggatcacaccaatggtgaattgtttggctggaggagcgccattgattttggcaaactcagcaattgcattcccaccattctcaatcttgatgagctcactaccttcttccgctcttctgcccattccttctccaacagcacgtttcccctcagctgcccattcctcagaacgcctaaaaatcgacttgatatccatatcggcaaatgcctcggtttgatctatagttaattttgacggtgtccttttgatattcataacagctttgggctgctgaatttcaaggtccgctctgggctgctctacttcttgtcgggatggagttgtcgacatttgcagctttgcataggtttgttgcattaacaatctagggatttgcatattggtacacctccatgatgcaaaaaagcacccaacggatgctttttattatcttaagaaatcgactagggatggctgaataactttagccgtcgttgctaaagctgctctattcacagtctcttgttgaagaagatcaagaatcgctttttcactttctacatcttcattatcggatttagcatctttcagcacttggaattgtgaagtcaaacggctgcctactaagtcaacacgatttgaacgggctcctaagtccgagcgctcagcactcatcacttctttaaactgatcgatacttcctaacgcatcatcagaatttgcgaacgttccatttttcaatgagttttctaaatccgtcagcatttcaatgacattttgaccgctggcagactgtccaccaaacgctgaaattggatttgagttcacatttaaagtgataccatcagaaatgttcgacttaacagaatttgcatctgtatagttttcaaagttaaacgtaaacgtaccatctgcgttctcaacaactggtttgacatttgtattcgtaccattaaatacgaatttacctaacatctgagtgttcatcgcgtcaatgatttgtttcttcatctgaccaatttctactccgatagctgctaaatcttctggctgctttgttccattagccgcatcaagcactttatctcttacatttgacataatatcaatgatttcagtgacacttgtttcagatgtatcaatccagttctgtgcttcatttaagtttttttgatattgttcatttcgaaacattgctgtgctatattgaaggctttttactgctgcaacaggatcatcagacgtttttgtgaaacgtctccctgtttgtgcctgctcatttattttagaaagtttttcataacttttactaatattacgaagtgagttttgagaaatcataccttgtgtgactcgcatcagttatacctaccttcctacgacacccatgccgtttattactttatccaatatttcatcttgtaatgtcacaactctcgcagctgcattatatgcatgctgaaattggatcatattcgtcatttcttcatcaatggaaacagcactcgtggacattctacgttcattggctgaattgacaagagcggctgaactgctttctagcgtcatgttctttttcccttgaatccccatctcagcaatgacattttggtagtaatcctggatcgttgttgtattgccaccgattggtaactttaagtcttgtatatttgctaatttagtagcattcgaaccgtcaccttgtgtttgattgagagatgctgcaatattatctgttgatgctaaaatgacatcactcactttgatacgagcagctaagcctttattcaattcattgttattctcaatatcaaagaagtcttgtccacttgtgccatttaacgtgtacccctgcttatgcacatcgttaaatgtatccataaatacttgtgctacttcatccagctctgcaagcatatctggatacatgcctttttcagcgccatttgacatgtagccataagcctcaacaagtgcttttactttaccattcacttgaagctgatctgctgcaatggttgttgttccgaattgaagtgagttaacaagtcccgttgtattatcataggagatttgcagttcagatttttcgttcgtaatgccattcaaaatcgttccagcagattgtccatttgcaccgataatgtcgatgttgacagttccttctgcaattttgagtgcattcccgccagatggattatagctcactttaatatcaacaagtgaagataattgatctaccaacgcatcacgcgtatcatatagatcatttggaagatatccgtttggctcaactgctgcaatctgtttgttcacttcatctatttgagataaaatcgtgttcacatttttggctgttgaatcgagttctgtttttaaattcttttgtatcgttgttaaagaagaattaagtagacggaattgatctactaaagcctgtgcacttgttttaacaactgtacgcgcagacgctgtatcggcattttttgtttcggataggacctgtaatgatttccaaaggttatcaaaggctctatttaagccttcatccgtcaaatcattcataactccctccatttgtgaaagggcgtcagattttgttgagtagtaagacaaattattgttatgatctctgaattgcaaatctaaaaagctgtctcgaattctttcaacggttccaacttgaacacccgtccccatttggccatacgtcttaccgtcataaactgaaatgactggataaggattatctgctttaaaggtaactctttgtcttgagtagccatccgtatttgcattggagacgttgtttgatgtgacataaagccctgcacgctgggctgtgattcctctttttgccgtttctagtcccatgaatgtagaacccattggtatcctccttgtttacgcctttgaatcaaacaaagccctctgctgtttaggctttgaactctcaagaccattttgtccgtaattcatattctctttattagggttaacgagatcgaatgtcagtgaaataaattgaagcgactgctgaatgagctgtttgttcagttcatttacatctttcagttccaccatgatgtcatttaatttgtcatataacgaaatgagctcttcttgatccgaaccttcagccttttcgatacacgcggtgatggttggcggttcatcactttgtaaaaattgaactgtcgcttcaattcgtttttcttctaattgagaaatggcctgaatatatttttgttctaaattcagaacctctgaaagagcatcaatctcattgcttttcagcatttctgttttatccttcgacagcttcaaaagctgttcatgcaatccatagagacgatgcagctcttcaataattattttaactgacattcacgctactcccttttgttattgttgtttataaaaattcagcattttatcagcaatgccctttgtatctacttgatatgttccggcttcaatgctttttttaatttggtctattttatcttggcgttctttcatgatattcggcaccttttgcatttcgattgcctttttagaaatttcgactttatcagttgattttgcttgatttgattgcaacgtttgtttctcatatgttttcttgtaaggatttactggctgtgttccatatcgattaattttcacgggattcctctcgctttccgttacagtctgtcttgattctatccattttatcgaccaaactgcaacttagtttagggaatcaatcgtttttaggattaatggcataataggtgtcttttttcctagattcaatctcccttttacgctcttcttcttggttcatttgactcatttgcgaatgaatgtcctgttcacattggctgcaaagcttgttttttctgatcggttggccacatctttcacaaggatagttgatattcggaaattggctaatttgaagtcttttcaaacggataaatttcaagattaattcttcatcaacttctgttgcatctactatttcagcaatggttgattgtctattactttgctttcgcaagaatttataaacgatatcaaaagaacgttcttcttcttcaaagcatttgttacaaaccgtttggatggtcgtttttaaaaacagctgattacattgtggacagtttgccaattgattcataaccaaaaccccttacgttattttctcttcttattatcggttaattatcctgaattttaactacggatcaacgtaaatgaggaaacacttttggcacctgcttcttttaaaattctcgccgcatcataaatggtggcccctgttgtataaatatcgtcaattaagataacatccctttgaacgatcacatctgtctgattgatttgaaacattcctttttgatctaaacgttcatttttctttttcttggactgtttgctttgatgtattttcacaagaggctgctggatcggctgaccaatcaaggaagcaagtataacggactgattaaaccctctttcatttagtctttctttacttaaaggaatcgggattagtacaggttctttaattgaaaaggaacgcttaaatatcgcttggacatcttgtttaaaaagctcagctaatgctgtatcacctcgaaatttaaagcgggaaaggacatctttcatcaaatcgttgtaagcatagacagacctatttttcacaagtactgtagtagaatcaaggcgttctttccacctggaacagtcttgacataattgatcattcgactgcgctctcccacaggctggacaaatcgggcgttgaattttttctaggcgatgcttacatgctatacatagacgatcttcatttaatagaagtaatgatttccatgtaaaagaagcgacaaaatgcccctcacaaatttggcagatcaattgttatccttattcattggcagacgattttcgcatcttggaaatgtggagaccttcgaagcggcttctgtcaggatgaccagcatggccgtattcttctgtttgtctaccatctccgatttactgtaagatattttatcgatgtctgttatatactgaggcttcacttgattcagtgaaattgctaatacatcttctatacacttttcacagtgacaaatcatgtttaattggttgagatattgatagaggatttccttgagaagtgtttcttttgcattgagtagcatatttgtctctcctgccatttgtgtattgtgaatataaatgtaccatgaaatttagttgaacccacattatttttcagagaactctttttcagctgtatcattcatttttacaatatgcttctttgcttgtttcatatttctcgttaaaccaaaatgaaaaaagaaaacatctcctttaaaaaaatcaggatgtctacctgctctaccagaaatctgaacaagtgcactttctgtaaagatagtagattctgcacctagtacccccacttgtacatttggaatcgttacgcctctttctagaattgtggttgtaactagtacatcgtatttattatctctgaattgctggaccttttgtttcctgtctggatcttcagcagacaccccttctacatttaagtggtgctttctaagaaccttcgttaccttcttcatagtagaaatagaaggaacaaaaaataaagtccttctcttttttgtaatatgattctgcatccaattcattactttagatgggagctgattcttctttaatttcttcttccaatttccaacccaatgaaaggatgggacgggtaaaggttgttggtgaaagcgcagaggaatttttatggcttctagttgtccgcgaaatacatcttttatcattttcttagacggcgtcgcacttaaataaaccctaacccctttctttctcattgcctttaaaacagcaaattggagacgttcatcaattgaataaggaaaggcgtccacttcatcaataatgagcacatcaaatgcatgtttatatctcatcaactggtgagttgtagcaatgactagcggtgctatttggaacctttgaggacttcctccataaagaacagctatgttcagtccttgaaatgctttcttaagccgcggctctagttcaaggacaacatcagttctaggtgtcgcaatgcagacactcattccttgatgtaaggcatattctattccgtgaaaaagcacctctgttttccctgccccgcaaactgcccagatgagtaaatcagatttgctttttatcgctttgatcaatttttctgatgctcttttttgtcctttagacaggtttccctgccatgttaattccgtgtgacatggttcttccatttgtggacccgtccattcataaagaaagccacattcctttgttttccccatcatgatgcatgatctacagtacacacaatctttttgacacttgtcacacggagagtgggcaaagtaccaattttttgatacaccacatctgcagcaaattagaccatttgctttcctctcaatagcaggtgttcgcataactaaccctttctcctccaaccaattcaaatcagactgcgagcatcttgtttcagcagtaagcaagtggcgtgactgcaggtgctgccctagttccattgctttgtccatgttcaatttcaacaaacacctttcaactgatgtttgcctattatgcgcaaagacatgatctttcgtccaatagctaaaaaagaaaaacaaaaccccttttctaagagaaaaggggtttttaggatttatctcatcacccagccaagagctaaggagccttcgcctagatgagtgccgattacagcaccaaaatagcttttataaaattcaacatgaggatatttttctgataagtgcgcaattaaatcgtctacttcttcttctctattaccatgtatcactgttgctctcatcgggacaccgcgtgatgcatcttcgtcaaataattcaaacatacgtgaaatggcttttttccgtgtacgaatcttctcaaaagggacaattagcttgttgtcaaaatgcagtataggctttacctttaagaggctcccaataaaagcctgagcaccatttaatctgccgcctctttgtaaatgagttaaatcgtctaccataaaataagctctctgatgctctttcaggtaattgagatgggctaacacttcttctagagaagcaccagcttggattttttcagcagcttctatcacataaaaaccttgcgccatacagctagtttctgtatcaaacggataaatatcaattccgtcaactaggtcatttgctgaggctgcactattatatgttccactaattccgctagaaaggtgaatactaatcacggcatcgtatgtttcacttagtttttcatataattctattagttcaccgaaagcaggctgagaggtggttggaaggtctttatgctttttgacttcttcataatatgtcttccaatccatttctatttcttcacggtatgattcgttgccaaaaatgacattaagagggatcatatgaatatgatgtttatcacgcagctcttgtggtatataagcagtactgtctgttacaacggctattttcattcttaaataccttccttatccgttaagttgctcttttttatttttaaagaatattcattgtgtttcattagatttataatagtaatcaaaaaagcctgcctaatcaataggcaagcccgttatatccgaaaaagactccttatctacctatcatttctctccaattaacatgtgagagaatcaaaaacaggcgaaaaaggagtacttgtccggaatattatctcatttctacccagccgttcttaattgctacaacaacagcttgtgtacggtcgtttacattcattttttgtaaaatgttactcacgtggtttttgactgttttctcactaataaagagcgactcaccaattcctctattgctctttccgtcagctaacatttgaagtacttcgcactcacgtctcgttaagatatgaagtggtctccgaatttcaggatatacttcatgctgcggatgtgctgaaacgccgctagtcgctaggcgccggaattcatttactaagttatgagtaactttcggatgtaaataagatcctccgtcagctacgactttcactgcttcaatgagcgtgtctgcatccatttcttttaacaggtaacctcttgctcctgtttttaatgcatgtgtcacatagttttcatcgtcatgaatagatagaataatgacttttgattcgggataaagctcaactagctgctttgtagcctctacaccatttacattcggcatattaatgtccataatgacaacatccggatgatagtgttctacgatacgtgcagcttcgtcaccgtcgtctccttctgcaactacttcaaaagtaggttcaaaatctaaaatccgtttgacaccttcacggaataattggtgatcatcaataattacaatatttactttagtcacaagctacgcctccccatgtttattgttctacacctgaactttatggtcaatatgtcttttgtctctattttacaattttattttgcaatgttaatggcacgcgaatcatgatgaatgtccctagacctatttttgagtctatggtcattttaccttcaagtaagtctacgcgttctttcatgccaagtaaaccgaaggatttgtttttgtttgttttcacatctttcatatcaaagccttttccatcgtctttgataattaacgtgacaaagtctttcgtcacttctacttttacagagatttcttcagcttcggaatgcttcaatgaatttgtgacagcttcttgggctagtctaaacagtgccacttcgaattgagaagcaattctttcattttctgtatcccctaggcattggaacgtgatcttggtttttccatcatactcttcgattgtgtttaaatattttcttagcgtcggaatgagacccaaatcatctaaagccattggtcttaaatcataaatgattcttctcacttcgtacagagcatttcgcacattctgtctgagacttctaatttctttaaagccttcttctgtcccacgatctctgaaaatccgttcaattaattcagagcgcatcatcacgtttgccagcatctgggccggaccgtcatgaatttcacgggatacccttttacgttcttcttcttgggcttcaataattctaagtccaaaatcttgttttgcttgagcatcttcaagtaacacgccaacttggcgtaagtcctggttgagatagttgagaaccactgtgatctggctcacaagcgtttcagagcgttcaatgacgtcttgcaggcttaacaatcgtctttccagatcgtctcttctttctctcagctgcttttcgcgctgctggatcatggtgagttccacttgcagattatgtgctttttcgtaggcctcccgtatttcttcttcgctaaatttgttgaagtttctgctgacctcagataaacgatttctagcatgtctcgtatggacttctagtttatccccaaaatcaattacttcgtttacttgctgtttgatttgcttcaactcttctacaaggctttcatattgttgacgggactgttcgcctatcctaaatacttcgtccttgctgccatcaactgtacttagcattttcatgatgattgaatccaataatttcggatccattttaggtgttgtcatggcttttccctcccgtaacagtgatgtcatctttttttattataaatgtcattgatctgcattttatgtcgaattataatgaaagaatgcgtataaatcatgaagtttttatgacgaccctttttctacccctatcatcataacaaaatacgctgtaaaattctaaaaccaatgcaaattttctctagtcttacaatttgcttttcaggagggtatgtcttttgctgaatcgctatcttacagtaaaaagccgtggcgagcatgagatcgtcattgaaaaatcacgttttatttgtcatatacagcgtgctgtctcagaagaagaagcacaagcatttatacaatccattaaaaaacaacattggaatgccacacataattgttctgcctatctcattggagaacatgacctgattcaaaaagcgaatgatgatggtgaaccaagtggtacagcaggtgtgccaatgcttgaagtgttaaaaaaacggaagctgaaagatacagtcgtagtagtcactcgttatttcggcggtattaagctaggcgccggtggtttgattcgtgcctacggaaaatctgtatcagaagccatcaaccatgttggaatggtagagcgctgtttaatgcgtacgatgcacacaacaatagattatacatggcttggaaaggtagagaatgagcttagagcctcatcttttcagctaaaagaaattcattatacagaagatgttatttttgagacatatgtagaagaaacacaaacagagcaattcatcgaatggatgactgagctgacaaatggaaaaagtgttacaaaagaaggcgaactgatttatttagaaaaggacattggtccgataaaggagacagatgaatggcacaacgagtaaaagtgcgtgtacgaaagaaaaagagtaagaagaagagaattttcaaacgtatcctggtcttatttttgcttcttatcatctgcatgggcggatttgcagtctataaaatagtcaatacacttcaagccgctgacaaaacatatgatgaactagaccgcggagagaaatcgaagcttcgtgatgcggtcattgatattaaaaagaagcccttctctgtgctatttgtcggaattgaggattatgccacagatggtgatcatggccgttcagattcacttattgtcgcaacaattaaccctcaagacaaaacgatgaaaatggttagtatccctcgtgacacacgcgtacagcttgcaagtgacacgacaggaagtaaagaaaagatcaatgcagcatatgctaaaggcggtaaagacgaaacgatcgaaactgtcgaacaattcttgaatattccgattgataaatatgcgaccgttgattttgacggattcaaggatgtcattgatgaagtcggtggaattgatatcgatgttccatttgacttcaatgaaaaaagtgatgtgaaaaaatcgaaaaagatttatttcaaaaaaggcaatatgcatttaaacggggaagaagcacttgcttacgcacggatgagaaaacaagatccacgcggtgattttggacgtaatgatcgtcagaaacaaattttacgtgcaatgattgatcaaatgtcgaagccaaataacattgcgaacgtcgataatatcgccaaagaagtcagtgatcacatttcaaccaacttccgtatcacagaaggtctagcgcttcagcaaatctacggcgggtttaagggagacgacacagaaacactttctattaaaggatcagatctttatttaggaccaaatcgaacgtattactttgagccagatcaaaccaatctagctaacgtacaaaatgaattacggacgcatttaaagcttcctgctgaatcttcgactgaaacaggatcaagtgatacaactaatccttccagcacaacaggccaataataaaaacagcccagttcctaggaacgggctgttttttattgtcttttgaccattcgtttatagaatttcgtaaatggtttgaactcttcgttgaccaaacccgtgacttccgcaatcacttgcataaacatcaccagtaaaaagataatgatgagcgataaccaaagggtcgcgcttgtcagcaaaatcgcacttaagctaaagactaacccaatcatgtaaatcacgatgacagccatgcgatgggacaagccaaaggccattagtctgtgatgaatatgagatttgtccggtgatgaaatcggctgtttgtttaatatgcgtctaatgattgcaaaggtcgtatcaaatataggaacacctagaatgatcacaggaacgacaacactaaacaaagtgacacttttgtatagccctaaaagtgacagcaccgagatcatatagcctaaaaatagcgaaccggtatctcccataaaaatcttcgccggatgaaagttgtaaaagagaaagccgatcgtactgccaatgacgacaagagataaagaaagaatcagaatcttatcagcggaaaatgccatcactgcaatcgttgttaaaccgatgacagaaataccggcagctagtccatcaaggccgtcaattaaattaatggcatttgtgatgcccacaatccatagcacggtgaggggatatgccatccaacctaactcaattcgatctgttaaaaaaggaacagagaagaagtccatttttaagcccgtgctcacaatcaaacaagcaacaagaacttgtacgagaaatttaaattttgcacttaaattatatttatcatcaaatatacctaaaatgacgatgagtacggcaccaactgaaattgctgtaattttattatgtagaaacagcccgcctgctaatgctccagccgctactccaataaaaattgccaaaccacccattcgaggcattactttatcatgaacttttcgtttattcggctggtccactgcaccaatcttaattgcaaactttttgacgattggtgtcacaattaaaactgtagccagagagacaaaaaacgctaataaggcgcgttcgtaatccataggtcagtctccttctaaattgaaatctgtattttgtatattggccgctctttccattatacaattgaatagaggatgatcacaacctcccccggtgatgaaacaaataaaaacgcacaatcccgaatgaattatgcgttttctttaatattcgttagttctaccatgtttgtgaacagcgcgtgccaatcttttttcttcgctcggctttgtcttagatgtctatagcttgtgtcatcttttttgctgatcacttttaggcaggcttctacgaagagcgcaggatcatcgccctctaaatattcatacacatccttctcttttagcctttccgttgatgggagatttaaaccgacaaccggtattccagcggctaaaaattcataaagcttgagagggaacaccgcttgattgtaaggggattgtttgtatggcatcatccctacatcaatcagcttcatataagcaggcacttcttctggagcaacagcacctatccaaatcacattaggcagtttgagtgcatgctgaaaagatggatctccattcgttccatccggaccgacaaataaaaatgtccaatcaggccgcatacgagcagcttcagccatcatgtcaaaatcgagctttggcttaattcctccgataaaaccaagcacggtcccttctcttccttccagcacatcttctttacaaggaagattgcttttcgcaaacacatcatattcgacgccattttccaccgtaaacacatcttttggttctcccataagacgttttttgatttgatcgtgtaaatattgagaagagcatgtaatgctgtgtgcatatttaatgatccgattttctgctttgacaatgacacgctgcctcatataagaaagaatgttatggttgccgcttattggctctccccacaggtcactgcaatcatagacaatatgtttccattcaaataaagaagataagagcggaaagcccggaaacgtataccacaaacaaacggcgatccccttcttttcctcctgccgcaaatgttcaagaagaggggataatttatgaatatagaacatgtcttgatatcggccaaagcgaaataatttgctcttgagcacatcaggaatggtcaattgcttcattcgatctgttatgggctgaaagggagctgtatgacgagatgatgacgggcatacccagatgacctcttttgtttctggatcagatgctagaaattcggccagccgatgccgtctgtacctcagtccgtcctgtccccattctcccgtcgctacgacaacatgtatgatcgagtctgctttcacctttatcaccttttttcccttctgtttataagcgcttcttcacagcatttgtcgcatagtgcataaaacaccaagacgctttgacaaaatgaagctgctcaatttctctgtagacaaaccacgtttttttcgctgctttccacttgttactagagatggagttcccaacgatgcgatattcactgagcggttcactcataccataggctgtaaatcctctttttagtatagacagccatgtagctaaatcctgccttgtacgaatgttcggcatctccacatgtcctaccttttgaagatcaagcatgaccgttaaacagccgataatggtgtttttcagggcttcattatagtctaatctcgctggcgcagtgacggttttctctaatggttctccgttttctgcaatgatgtcatatgccgtaaatgtaaaggcataatcatttgtcagcatgaagtctacctgtttttcaagcttcgtctctttccacatatcatcgctgtctaaaaaagcgataaagcgtccctttgcctgtttgatggctgcgtttctagcaatggcggctcccccattttcctctaaataaatgacgttgattctgtcgtccgcttgacttaaatcccctaatagctttctagttccatctgtagaacaatcatctgcaatgatcagctcccaattggaataggtttgggcaaggacggaatgaactgtatccgttaaataacgttccgcattatacgccggtgtaatgatggatactaacggttgattgttcacctaagactcatctccagttcattattaagattctttgaacacttcgggtaagaccacaaacatgagcgagatgctaaagccaatgacaagcccaagcagtgcccgttttttggctgacatgcctttattgccctcatcaagtacttgggcaggatcgacaatctttgcctgcttcattccaagctttgttgactccaattcatataagaatcgttctttatcgactttggaatcattgctgaccgcttcgtcttcaagagcagctaatctattttcgatgacccgctgcctttttgtgaataatgctttgtcttgcttgagaaatgtatccgacacctgcttcacaacagccaaagcacgatccttatcggcatccgtgaaagaaagctgtaattgtgtatccgattgattggtaagaataagacgcgttttcacatcctgtctttcttcttctttcacatcacttagtgcttcatttagaaatgcatcgctttttaatagagatgtcacttctgccatattgttatacaccccatcatcatatttaccgagagtgagggtaacagcagctgtataactagactgctgcgtcgttcctttagcaaaaaagaaaccaaaggcgcctaatacgactggcagcagtatgagccatacgatgtaccttttgattcgcttccctatcctagatatgaaaccagacatgttcattctcccaacattgacgtatttgctctttcactagtgtagccatacaaacagagcatcacacacggtttaccacagcttgagtcgttgtttgtttttcagcatattcaccgctgcgatcaccagtcctaaaaatacccagtggaaatataaattcgagacggagctaggactgatacttgaaacgagaaagctcagcatggctgcaaacaacccctcaatgatcatttttgccgatcttgtgtcagcccattggtattgtttgtacagtgtgaacatgagataggcgtatagtgagatatagcccaccatgactgcaaacccaaagttcgtcatcaattccagcagccaattgtgcacttctacgacctgatctgtatcaaagatcgaaaagtgagctaagtagtaagacacattccccgctccaactccgaatccgtatgaattcgtaaagaagtgccaagcatttttgattaaattcgctctcgcaatgttagacgggaggggttcactaaaagaatgcgcgacctgagaagcgagaaacaagtcataaaaaactgaataaatcttagctgaaaagactgcgataccgatgacgacaagtccgcttgctgcaatgattgaccactttttgagaaaacgcgggagcagcagccacacatagatcgccactcctgctaatatcccaagcagactagcgcgggattcggttaacaaaatgagatacagcgcggcaattgcacctaataatccaaacgctttgatataaccgtttttcatttgacgcatgcatgctaggtataagaagaaactaatcgataaaaacgttgcaaagtcattctgattaaaaaagacagatgtaggatagtgctgtttatacgctggccctagatacaatgaggtattcggtaaatggttcaatgtaaagtggttatagaacccaatccccatcacaaacacagtcatgacaagccaaatgctataaaaggtcactacttggtccattcgctgaatatacatgacgacaagaaagacaaatcccatccccattgcaagaagggacatatacttcaggccgtctgtgactgaatgagcccaaagcagtgagataagcccgtaaagaaaccatgcagcgaaaaaaccaagcatacctttgacacgaatctgctgccactgagatatgtacgtccccttatctctcatccgccatatgaataaagcaaaagcggcgatgagcatgatacggtagagaaaaagactaaagaatcctgcactaatagaaaagaaagcgttgttgagaaaggtcaatgtaatcaatagatagatgactgacatgaagagttgctcaccattcatgtacagcttcatcaacacgagagcagccgacaggatcagaagtataaccggaacagccaccatcttctttaacccgacgggctgcgaggatgccaattgtacaagcccgatccctgctgcaaacaaaatacaaccaatcatgatttgccatgctgtttgtttcacactcatacccattatcctcctaagcaacccatccgatttgagcgattaagccttgacctcctgttcatagtaggaaatggtacgagccaaaccttcctgtaaactcacaacaggctcccatgataagacttgtttcgtttcctcatttgccaatgtactatgcacaatatctcctgcacgctgcggcttgtaaattggttcaagatgcgacctcgtcactcgcttcatcgtttggaacagctcattcacagtgatcgaatccccacatgaaatatttaaacaaacgtttgattgagctgttaaagccgcaacattcgctgctgctagatcacctacatagatgaaatctcttgtttgttccccgtctccaaaaatgaaaggagactcatcctttgcaaacttatcagagaaaatagagacaaccccgccttcgccaagtgcgtcttgtcgcggaccataaacattgctataccgaagaatacaatagtccacatcatacaatgtttttgccatttctaagtaccgctctactgtgagctttgataaaccatacggcgaaccaggctttaactggtgcgcggtgtctactggcagatacacaggatctccatagacagctgccgatgaggcaaataccactttcttgacaccagcctctgaagccgctttgatcacatgcagtgatcctttaatattcacttcttgatcatatatataatcattgacagatactgcgacacttacttgtgcagcaagatgaatgatgtagtctggtgcgatttgtttaatgatttcaaccacttctggttttgttacatcctcttcaatacatggaacagataaatgtgcaatattttccttcctacctgttgaaaagttatcaagcacgatggcctcatatcctttttttattaatttttcaacagtatgtgaacctataaatccactacctccagtaaccagtactttcttcatccaagttcctcctaaaaatcaagcttctaataacatcttaacatcctgtacatgtggacggccgatcgaaagataaataaagccgttttttctcatttgttctggttcaaatatattacgtccatcaatgatcactggacgttgaagcagtcttctgactttctccatatccatttttaatacttcttcccattcagtcaagattaaacatgcatctgaatgctctattgtttgatataggttgtcactgaatatcgtttggtttccaaggatcttcttcgcttctaagtgagcaattggatcatacgcttttacataagctcctagatcttgcagcattggaataatatcaagagcaggtgaggatcttaaatcatttgtgttaggtttaaatgccaatcctaatacagagatcgttttccctttgatatcaccatagacatccatcaatttctttacgagataggctcgttgatgtgtatttgtttcgacaacagattcaattaacttaaaacgatagcctactgtttcagctatttttaatagcgccttggtatctttcggaaagcaggaacctccaaacccgactccagcttttaaaaacttttgtccaattcggctatctagaccaacgccttctgatactttctcaacatctgcacccacccgatcgcaaatattggcaatatcattgataaaagaaattttggttgcaagcatcgcatttgctgcgtatttaatcatctctgcactttctagattggtttcaaccactactgtttgaaatggttcatgtaaccccttaatgatctccgatgcatgagagcttgtagaccctataaccacacgctccatattcatcgtatcttggatggcagagccttctctgaggaactctggattggatacgacatcaaaaggatatttactgcgcgatgctttttcgacaatggcttgaacgagccggcctgttccaacgggcactgtgcttttattgacgatgattttatagccatttagatgttcaccaattgtttgagcgacagctttcacgtacgttaaatcagcttccccctgtgctgtcatcggtgtccctacagcaatatagataatctctgattcccggatagcagcaggaatattggttgtaaaaagcagtcttccttcttctgtattcgtttcaatcaattcctttaaacccggttcataaatgggaacgacaccactttttaagctgttgatttttgattcatcgatgtcacagcagatgacacgatttccgatatcagcaaaacaagtacccgatactaacccgacataccctgttccaatcacagcaattttcttcaacatttttcatcctctcagtaaaagcatattgtccgttccaagctgtttatctatctatcattctttgcacatttcatcttgtttaaacgatggatcttgattgatgaagtaccttttcatactgctgtatgagctgcttcgtattatttactgatgaatattctgtatgaacgatttgatacagatcgcttttcacttgctcattccatctgttttcataaagataggcgtgaatggcctcttttaactgatttgccgaatgcggatcaacgagcaagtgttgatagctagaaaataaggttgggagaccaccgacacttgtcgcaatgacaggcacttttaaagcgagcgcctccagaacgacggttggcattccttcactataggatgggagtgcaaacagatcggctgccaccaaatagtctttcacctgatcattcggcacctgccctgggagtataatggatgctccagcccgttctgtgagctcctttgcaagggggccttttccgacaaaaactgctttcacaccatccatgccgctgacagcatcagctaattcaagtaagcccttctctttgactaatcgcccgacgaagacaacgagcttgtcgtgaaggggtaagcctaacttttgcctgatgccttgttgatcttcttccgttttagaaaatgactggagtggaataccgagcgggaggcattttgcttctactttggtcatatcatttgtctttttagcaagctcctcgctcaccgtcagaacagcagatgcctgttttaccgccgtttcaaaggctgcatttgcccctttgctatagcccggatacacgttcacatcactgccatgtaaggtcaaaagataaggaatttgcgtttcagtctgaatcacagccgccgctccgccagatggcatcgcaaagtgcgcatggataaaatctggtgacagctggtaacgcttcatagcgccgagaacagcagccgctattcgtttactcggctgtgcccattttagctgtccagggagcgctgtatagtgcggcctgtatacggtcactccgtttctcacttcctgttcgggcagatctattttctgccgataggacgccttcaacatccgtaaaaccggtgggttgaccgggttgggacagatgacggtcacttgtattccttgtttgagcagctcctgcacttgcgtttcatggaatacgccttcacttggatgtttttcactaggatatacacttgtcagccatagcaccttcatgacgaacgacctcttctcaataatttgcctgctacctgcggatacattttgatgagcagcaagccatacaacgctgcactgacacaaatcgtcagtcctaattgaagtaaaatgtctgctgatgtcagcttcatcccttgatgcagggttaccgcacaggcggccatcaatagcgtcataacagcaggtttgctaagtgattttaaatacaccttcatatcaagctgtatgacatacgccatgagccatctgccaacaataaagttgagcaggctgacacctgagtaaacccaagctactgtgagcagactgcctgtgctgacacctgcatataaggcgcatccatacacaagaagcatccccgtatcccaataaaaggctaagtccgctctcccctttgcaaggagtattgacccgtttggattcatcagcacacgcagaaggccgacaatgcacaatatattaagaaccggaacagctacgagccatttctctccaaacactacttctataaagctatctgatacggcagcaagaccgattaatagtggaaagctaatcaatgcgagcatattcgtcatactgaggaagccctctcgcagcatggagtgatcacgctggctttttgcgaaaacagggaaggccactctcgtcacaattgggttaatcttcaacacggggatcgtcacgatttgatacgccaagctataaatgcctaacgcttccgctcccagaaaccggccgattaaaatcatgtctatgttcgatcccgctcgattgaccagtctcgatgcgagctggaatgcaccgaatgagaaaaattctttcacttctcctaatgcaaaaacaggtgctgggcgccacttcttccaataagctgcggcatacataagcccttttcctgattgcagcagcacttgagaaatgacataggcaacaatcggattgatgaagaaggccaaagcgagtaaaacaatcagcgatatgatagttgtaatggcttcaatggcacttaatgttttaaaggctaggtctttttgcatcatgtattggtattgctggccaataggagcaatcagaaacataatcgataatagtttcagcaacccctccagctctggccggttataaaaggcggcaatcattgggcttactagaatgagtaaacagaataagacaactccagtgagtaagttgatccaatataatgtagataattgacgttctgttgtttgttccttttggatgatcgctgccccgatccctagatcaagtaaaatctgcgtaaatatggtgacagttgtgatcatgccaacgagtccaaactccttcagtgacatcacgttccctaaaaaggcgaactgtgcaatttggatgatcgtaatgatgaatgcggacaagcttgtccattttgccccgcctagcatgcgttttttcatacttgccatttctcttccctactttacttatctggctccgtcacccgtcatgatgacttttaacgtttttaccataatcttcgtgtcgagagaaaatgtcaagttttgaatatactgtaagtcatgtgttaatttttcacttgggctcatttcatatcctccatttacttgagcaagacctgtcagtcccggcttgaccgctaatcttttcgtaaaacctggaatcgtccgattaaattctgcggtaaacatcggtctttccggccgcggacctacgatactcatttctccttttaacacgttgatgaattgagggagttcatcgattcttgttttacgaatgaaggctcccactttggtgatacgcgggtcgtttttttgtgcccatttcgctcctccgctctcagcatcggttctcatcgatctgagcttccataatttaaagtaaacaccgtctttcccgaccctctcctgcatataaaaggctggtcccggtgtttccagcttaatcaaaagagcaaacagcaaaatgattggcgtactcaacatcaatccgatgaacgagaacattaaatctatgaaacgttttgcaaataaataacgaaccatatgttctgttaaggcaaaagagtggtttcgtctcacttcatattctctataaagattcatcgctttctctgcactcactgacctgcacctcaccattcaaattagttgttgtgtaaagagatgttctatgaaagtcagtttagcagagcaacattaagcaaatgtaaatgcgctgttaagtcttgtaaaactgtgttaagaatgtgcacttatatcaagttatgcccttttcaacgtaaaaaagacccgcaattctgcgggtctccgtgtcttttctttattttgctttaacggattcgattgtttttaatcgaagggttccgtttgcatcttttgtataagttactttcacttttgattcttcttttaagctgttcacttgtttagaaaacgtatttccaaattgaatagcgacttctttgccatcaatgttcacagcgatggtatgtccatcagccaagccgacatatgtgccttccttggtgacttcatttttattatttgttgttgattctttctttgttttagaatcagtttttgattgttccttagcaggttcttcttttgtgatttctttacttgagctgtcttttgcctcttcatcagattgaccagattgctcttctttttgagcaactgtttctttactttgatcatctgctttttcatttgatgactgatcttctgttttttcctctgaagcattttctttcttttgatcagctgcttcagttgtttcttttttgctgtcatccttactgttgtcgtttgattgatttgttgtgccgcatgctgtgagtaatacacctagaagcaatactagaaacggcattgtgattaattttttcaagatcgtcacctcttcatgatttgtcgattggctatcgcttgaagattcatgcgtaaaccattcaccttttatgtttcaattataacaaagataactagaaatgaaatgtatttttaacttgacacactattgatgactcgattatttcatagacttttgaaaaaaggctgccgagagacgttctcgagcagcctaagaggagtatcataggcactcctcatatatatgttttcttatttaaaataacctgacacaccgcttgaaatacctgaagctagtcgatctttatatgtcgccgatttcaaaatatttgaatcaaccgggctagtgataaagccagtttccagcaaaacactcggcatctttgaatacttaatgacataaaaacctgctgttttcacaccacgatctcttgtacctagtgcactaaccattttaggctggatgttttgcgcaagtttcaaactgttcgcagccgcatatgttttgtcataatacgtttctgttccatttgcgctgctgttgtcatttgcgttcgcatggatactaataaagatatctgctttcgcagaagcccctttacttactcgtgtttcaagactgtcaaatgtatctgatgtacgtgacataaccggtaatgctccagaactatttaattttgtattgagacgcttagcaacatcaaggtttacgttcttctcaagaagaccatatcctgtggcaccagagtcttggtttccatgtccaggatcaataaaaacttttttcccaacaactggatttttcaattgagaagtcaccgtatttgttacagtggatgtacctcctagaacactaaatgaagtgatcttctttgaaccaatgacttgtctagttgctttcggtaatgttttttcattcgtgaaaataaaagctttaccttgcttagcagcgatactagctcctgaagctgcatccgcatatgcaaaaccattgctaatatacgtattgcttgtactcatattgtatttcgttacaatatttgctgcaacttcataacgatttgctccgccaactcttccaggtgaaggcaacttcgcataagttgatttatttacactagattctccaccaatgacaatggtctttttaatccctcggcttttaatcaccgctgaagtttctgagcgtagctctttatcattggttaataagattggatatccttgttttgcagcataaggtgcaatggcaactgcatctgcataagcaaagccgtttgctacaacagccgtactagagcttttcatttgttttgcaatatttgctgctaagtcatagcggttcttaccactaatacgtgtcacagaaatgcccattgactttagctgagttgtcaccttgctagagacactctttgttccaccgagaatagtcacattctttgtttttagactttgaaggcctttttttgtatctgtagataaactgctactgtttgtaaaaagaacaggtgcatttttttgatatgcataaggaaccgcacttaatgcatccgcatatgcatctttccctacaagaacagccgtgcttgatgttgtccagccttttttcgccgcattcactgcaacaacataccggttcttcccatcaagccttgtgactgaattgtcagcaagtgcagatggaagaaacagacacatagctattacacttaaaaatactacttttatgatagagcgcacgtgtataacctcccttgatattttaatttgttgttaattttgcacccggataatagaatgacaaaatgcttgagtatgtgcttcctgattcagctctcattttcgctccatattgactcattccaactccatgtccatatccttttcctgtgatagtgaaatcattggtgttgttcttcactgaagcgtatgtgctttttaaattagtggcaccaagtattgatctaaattcagtcattttaaagctaagtgtcgctgatttactcatactataggttcccgttttattttttaagtgatagctgacttgcatagatgctgtttttgctctctttccttttgttgtcccagaaaaggtgacgttggaaattttagcgatcttgatgtctgaagctgatgtttctttattttttagaatccagctcttcagaccttgcaactgacttgcatttgtttctgttgtcttactccaccaagatgctggtgatgacgtgctgagagatgtactcaattgtgtttttgatagtttcagtgtccaagcatttactggatcttttgaatctgctttagcgatcagataaggaaatgcacttgaccacacttcttcactagcctcagtgtagcctccattactagaataataggttgcagaaatcagactattattatattttaataccttgccttttgtagcatctacagctttcgtggagtttgtagaccagttatatccgccatatacttggaatgctgttgtatccggcacaaccttccctatactgctaacagaatatgtacgtgctgcaactgcctgtgcttttaatgcctcaacatgccagcttgcgggcatttcattcggtacaacccctttaagataatcttcaaaagggatgttttcatttgttggtcgaatgtagcctgattctacagcaaaattcatgttccccaagtatgctttcccagcaactcgaatgacatttgtagttgaatatttctctggaacaactcttactgaagatccaaacgtcttgatgcctttcattgaaattttcccgttagaaacattcaattcataatccttattattcttcaaataaaattcttttgataattttccttgtaaacttgctgaaatagattttgttccgccagacaattggaacgagtgcgtcccctgttttttgacaactgatgtcactggtgatgttaaactattttcttttacaagtaccattgggctgttgttctttgctgctaaaagtgaaaatgtaatagcatctgtaaagatagagccatttgctaggtataacttatcagcattcatgtttaatccagttacaatgtttgctgagacctcatatctatttgctccacctattcttttcactgtggacgtttttttaatttcagtttcaacttttttactgacactcttttctccaccaacaatgacaacattttttgggagtttgtaagttggtaaactgtctttcttcgttaacagaataggatagccgtttcttgcagcatatggtgttactgaagcactgtcagtaaatatgcttcctgttgccacaacagcttgactatagttccccatctcttttgcgatattttgtgaaacagcataacgcgatttaccactgattcttttgatctttccgtatttcttcagtgttttctcagttgctgaagaaacacttgttgttccaccgataatgagaatattgtcagggctcatttttgcaatttgcttttcagtggtttttgtcaattttttagcattcgtgtataaaattggtgcattcaacttataagctaaaggtgttgcggaaatagcatctgcaaacgcatcacgatttacaataacgattgtagagggatttttccaacctgccgacgcaatattattggctacctcataacggttcttaccatcataacgggcaattgaagatacatttgtaccagtcactttgtataagccggatgatgatatattaaagctggttttgttcccaacatagtttgataatttaacagaaattgttgagcttgcagctgaagcatcatttgaaataaacacaaacaaaagaaagataaacattgtaaaaactagactcaattttttcaatttaatgatcccaccgtctctctattgaactttttcaatcttttgaatctctttttgaccactgtcattaataatgtaagagatttctactgtgtctcctggtttaaattcatttaacacatctttaaaattatccgtaaattcatagcttaaggtcgtattcacttttttcacttcgactgtatgtgcatcagccattccaataaattcagctttttcttccagcacctgaggagttgaactgcttgtcttgttttctcccgaggactgctcagccgttccacatgctgtgagcacgataccaagtagtagtattaagaacggtaaaacgacgattttcttcatttttttcacctcatgtctttgtatcgtcttataacttaatattttaaggtaaatttaaggttttttgaaaccttttttttgttacaccgtctatatctaggttcagagtaaaaaaataacttgtttatcaagattcgtaaacctataatcatggaagaatcatagaaaaggtgagggacattatgagagctgaaagaaaacgaaagaagaaaaaggttctttggattgttttatcgattattggcttattcgtattagcaactggcggatatgcatatcatctttggaatacagcagcatcaaccgtggcaggcattcaggagaatttaaagaagtcagataagcgtgacaaagatgtcgatttaaataagaaagacccgatttctattttagtcatgggtgttgacgaaagaaaaaatgaccgaggccgtgcggatacattaatatacatgaccgttaacccaaaaaccaaaacaactgagatggtgagtatcccgcgtgatacgtatacgaaaattgtcggaaaaggcacaatggataaaatcaaccactcctatgcattcggcggtacacaaatggcagctgatactgtagaggaattgcttgatgtacctgttgattacttcgtgaaagtcaatatggaaagctttaaggatattgtcgatacacttggcggcattacagtgaacagcacatttgctttcagctatgatggccactcatttggtacaggagaaattaatctaaatggcgatcaagcccttgcctacacaagaatgagaaagcaagatccaaagggtgacttcggacgccagcaaaggcagcgccaagtcattgaaggcatcattgctaaaggggcaaacatttcatctattacgaagttcggcgatatgttcaaagtcgtggaaaacaatatgaagaccaacatgtcatttgatgatatgtggacgatgatgaatgactatcgtgacgcaaggcagcgtgtgaagcagcacgagctgaaaggtacgggagcacgcatcaataatatttattattatcagcttgatgatagcagcctagctaaagtgaagaaggaattgaaggacagtttggtgcagtaaaaaaagaagactacatgattgtagtcttctttttttatgatttaaatggggccggtttttcttcacttaatccaaatcgatgaagaagttcttggacgattcgtttcgatgcttgtccatcaccataagggttagacgccttcgacatgctgtcatattccttctgatctactagcagctcttttgccattttgtaaatggtctcttcatccgtacctgcaagcttaagtgtgccggctttcacgccttctggacgttctgttgtatcacggagcactaatactggcttccctagagaaggagcctcctcttgtacaccgccagaatccgttaagataaagtgcgaagcggcagcaaagttatggaaatcaacgacttcaagcggttcaattaagtgtacacgatcgagaccgctaaattctgtctgagctgcatcacgtacggcagggtttagatgaacaggataaacgacctgaacatcttcaaactcttctacaacacgtctaatcgctctaaacatgtttttcatcggctgaccgagattttctctgcgatgagccgttaacaaaatcattttatccgtccctattctctctaaaatagggtgctgataatgctcagtaactgttgtttgcagggcgtcaatcgctgtattccctgtcacacaaatggtctcttcttttttattttctattaaaagattctgcttcgcttcctctgtaggggagaaatgaatatcggcaatagtacctgtcatttgacggttcaattcctctgggaacggcgaatatttattgtgtgttcttaaacccgcttcaacgtgaccgactgaaatttggtggtagaatgcggccaagcttcctgcaaaggttgttgttgtgtctccatgaacaaggacaatatcaggtttttctttttggaataattgatctagctttaacagtgcatttgatgtgatttcagataatgtctgccgttctttcataatatttaaatcatgatccggttgaatgtcaaaggctttcagcacttgatcaagcatttgcctatgctgagcagtcacagtgacagaggatttgatttgcggatgctttttaagttcaaggacgagaggggccattttgatcgcttcaggtctcgtcccgaatacagtcattacatgtaatgttttcaatagtcgatgcctctttccttctcatttatcatatgtttattatacaaaagaatagaaacgaatcctaatcattcattgttcaatctttacatcacctttacccttttcaacataaaaatttacacgaactctttacaatagatgttgtatcagtttatacatttatcttaaatcatttgtcatttctatcatttgtaagttacactttatgaaagatgaaaaatgaagtcaaatcattttttcaatatgtaaggaaggtgcaaagttcattgaaaaaagtacgtaaagccattataccagctgcaggtcttgggacacgtttcctccctgccacaaaggcaatgcctaaagaaatgctgccaatcgttgataaaccaaccattcaatatattattgaagaagctgttgaatcaggaattgaagacattattattgtcaccggaaaaggaaaaagagccattgaggatcactttgattttgcaccagagctagagcgcaacctggaggaaaaagggaagagcgagcttttagagaaggtgagaaaatcctctaacattgctgacattcattacatacgccaaaaagaacctaaaggacttggacacgccgtttggtgcgcacgcaattttatcggtgatgaacctttcgccgttttattaggtgatgatattgttcaagctgaaacacctgggcttcgccagctgatggatgaatacgaaaagaccctttcatctgtgatcggagttcagcaggtggcagacagcgatacacatcgctacggaatcatcgaccctcttacacaagaaggacgccgctaccaagtgaaaaactttgtggaaaagccaccgcaaggtaccgcaccatccaatctagccatattaggacgttacattttcacgccagagatctttatgtaccttgatcagcaagaaattggtgcaggcggggaaattcaactgacagatgccatccaaaagctgaatgacatccagcgtgtattcgcctatgatttcgaaggaaaacgatacgatgtcggtgaaaagcaaggcttcatcgagacaactctcgagtttgcccttcaagatgaggatctgaaaaagaaactcattccatttatgaaacagctactcgaaaaagaagaagtgaattaaaaaaagctgccgggatcggcagctttttatttaatcaatcactgaaatcgtcagtgtatgctgttcattatcaatgacaaacaggttattttcgcccttcactgcgaatttcgtttgtttctcattcatccagatattctgttctgtcagcccaagtgtcgaaggagagatcgacattacctcgtgaaacacaatagcacttgcttggccgttttgaataacatagtcagttttttctgtgatcaatcgctccatcgtatcaccttgatcacttttgatcgagcttagcgtttgcattttttgcttaagcacagattcttcttttccaaggaaagaaagtaaaaactcatacgaaccagcagatgcgggcgatacatacgagttgaactgtcctggtcgaatggataaagactttaattcctctgcaagttgaagcccatcaggtttgacataatacgtatctgatgctgttttgatttgaacggtttgtttattttcagcgacagcttgtacctcttggccaaatggcaaagtgacatctgccttctttgttatagcttgatctttgtacactgtgagtggatctgctgtgacaatcatctgttgatccacctttttcatatcaggcgcccctttcgttagtcgattctttgattgaggcgcttccgtcttatctgctgggatggcaccaaatgtcgccagtgttcgcagcggacgatccgaaaacatcgataaggcaagtaaaatagttaaaacagcaataatcgtcacttgaaaggctggtccaaaaaatgaacgtcgtttcccactttctttataacgggtcactttttcagtcttttgtacgccttttctaccttccttatgttccatttggtattttcgtttctcttttttggaaagcttgttaaaccagtcaacaaactccttatactcttttacaactttcttcgtatcatcaaacatacgaagttcaccataatgcatccaagccacccggtcacagattttttgaatttgactaatggaatggctgacaaaaaagattgtcttcccttgttctttgaattctgtgatacgatccacgcatttttgatagaaggtctggtcaccaaccgacaacgcttcatcaataatcaggatatctggatcgatatgcgctgaaatggcgaagccaagacgtgatttcattccgcttgaataactcttcacaggctgatcaataaagtcaccgatatccgcaaactctacgattttttcataaagctcgtctatctctttattcgtcagccccatcattaagcacttgaggcgaatgttgtcttttccgcttaattggttgttcagccctgctgcaatggcaatcaatgaaggctgtccatccatatcaatttcaccacttgtcggtggaatgattttcgcaagaagatttgacatcgttgattttccagatccattgatccctacaaaaccaatcgtttcaccttcatatacatcaaaggacacatcacgaacagcaaagaaccctttttcatttttattaggtaaaaacagccctttgatcttatccgactgctttttatataagacgtattgcttggatacgtttcgaaacgaaacctttagtttcatcgtataatctccttactttttaaagaaaatcgacaaatttatccctaaatttcatatgaagcaatgaaccgactgttaaaagaagaagcgtgatcagccaaaaataaagtgtatacttcacatcatggaaaaaccaatctccctttaacaagctatttctaaaaccatcaataatatagaaaagtggattcaatcttaatatatccccaatccatgctttgtctccagtgagcttctctgaaatattccaaaaaatcggcaacaaaaagaaaagtaaacgtgtcactgattgtaaaagaaattgatagtccctcacgagtacgctaatcgtggaattaaacaagctaaacgaaaacataaacgcgatcatacaaataaagtagtatatatattgcagccagtgcgcatcaggatatatgccataggaaatgagcacaatcagatagacacccatcatgacaaagtagctgaacaaattggacataatcactacagacggcagcgcactaatcggaaagttcattttcgataccatattaatgcgtttaaacacactatttgaaccatcaagaatcgtcggactaatgaagaaccaagggattaatcccgcaagcatccaaatgataaatggaacttccattccaccaatgacaatcggctgtcctccgcggattccaagaccaaaaacaaaccaataagccagcatttgaatcaatggatttaaaaactgccataaaacacctaaataattcatctgatattttgattttgtttcataaacagcaagtcgcataatcagcggaattgagctgatttgctcctttagtattgtcaacattgcattcattgttatcttccttaacaaaagttttgagtaccattaaaattaaaagcaccgctcataattgtaacagatgttgtttattttttcactttaaagtcaaaacaaagatgctatcattcataagtataggaattatttgctcaaccatatgatataggcagatttgggatgatatttacatttcagaataatgtatgttaaactatcttgactatataatcagaacatattaatttaatatccatattatagttattacgtattatttttactaattcaaaacagattattaactagattttaaggagagagactatggtttctttagaaagtattttaactagtaactctatcttatctttgtttatacattcatatgataaaaaagacctagaaacagttaaattcattcgtgataatcaatcatttgattttcctctacagcagaataaagatggtttttacgtagcagaaatacgtgctaaagatattctccctctaaaaggttcctctttcagtatcttcgtaacagatcaaggtggaatactcactccactacagtatgctgttcatcacaaatggcaaaggaagatactgcatagagaattggctgtattaattaaaagaacaagcaatgaaaatttacaaacaaaaataactttcgaagttttaaacgctagaaaaagaacaaaattatacaaaacaaatatgattgatttcatgcttgaaaattatactctaaacataaatggtgtttcaaatattttagacattgatgctccattagaccaaagaaaattctttattgctcttcatagagtaccttcaaaggataaaatattatttcctattgattcaatttcagaagatggtttttggtctgcccacatagacttaagctcaattggccttcataatttatatgagggtatctggcaaatgcatttttacgaagaagtagaaggcaagttgctaggatcgtttataaaagacaaacaaaaattgattactacacattcatttaagactgctgatcagctctttcagtgtcattttaaaaagaaaaacagtggattgatattagatgtcagacaagagattctacttgtttcttttaaagagagctatattcaaaatcaaacgatgattgcaaaaatatctatagcaagtgagcaactagcattaattgatcatcatgtttcagaaattcacatgttaaataaccaagacactgagaatacagttttaacaaaattgaaacgtatcaatgatgcagattttattttaaagataccatttaaacatatcattgaatccttacaagaaggaagtcagaaacaatctgactggctctttttattaacaaataaaaaaagccagaagactttctttgccaaagtcactaataccgctttgacctttgatgaaaataacgttcttcatgtatttgagaaagtacctttcgaagttggattacatcgaacatctagtcaaaacttgagttttacaattcgaaaaactagaaccgtaagaaatctctatcaagtcaaaaaaatacgtggtcactacttaaaaattgaaggtgcttctattttaagaggcttggaaatgcctaactcagaatctgtaaaacgctcattggtactaaaagaacgcgcatcattaaaagaaataaagatccccgtacaaaataaaagagacttaacttttgcttatcattataaacgggataagaaagactacacgtactgtgggttcaaagtgctatttgatacttccacacttcctgaagaaaaaggagtgtgggatttctttgttagattcgatacagatcaattttcatttgatagacgtctagggtttgttaaatatacctataaaaaagacaagtacctttctatcatcaagtataaaggtaacgatgataataaaattttcaacttttcgtcaacaacacctaagggaaatttaaaattagaagtactcccctttaaatcagctattgctgaagatcaaattagtgaaagccgagaagaagtttggattattggtgaaagaccagatactgctcaagatacaggctatcattttttcaaatattgcagagaaaagcaccctgataagaaagtttattatgctatagaagaaggaagtaaagatattcgaaatattgaacatcttgggaacgtactgatcattggttcaaccgaacatattgaaaaaacattacaagctacacactttatcggttctcatgacttagaatatttccttccgtttaaaataccacaatatcaacatacgaagaaatcaaaaaggatttttctgcaacatggtgtgatggggagaaaatcggcagaataccacagatttttctatcaatatccttttcatatagtatgtgtcagctcagtttatgaaaagaaaatgatgatggatcactttggttacaaagaatctgaggttaaggtgactggcttatctagatttgaccatttagctaattttaagacaactgatgataatcgtgatagagagattttaatcatgcctacatggagagaatggcttaatacggaagaaacattcttaaaatcggattattacgagaagtatatttcgattctaaaagacgaaaaacttcttaaagaattaagaaaacatagagtgaaactattattctatccacattacagaatgcagccatatatctcttatttcaacaaatataagagtgatgtagtttctattttggaattgggtgaagtgaatgttcaggaattattaatgagagcctctctccttattacagattattctagtgtttcatttgatgtgagttttatgaaaaaaccagtcatatattatcattttgattttgatgaatttttcaataaggggattttacggagtaaggaagaaacattcctaggcgaaattgtagaagatcaaacaaccttagtaagtgaggttattcaaacgattaataataacttccgtgagaagttatttgttgaagaaagaagagatttaattctaacgtatactgataataaaaactgcgaaagaatattcaatgaaatatcttctctaaaagatgatgaagtttcagtaatcgattccataacaaggatttctaaagaaactcttcaaaatataaagatagcaactatacaaacattagtacgaaattatattttcaccattagtgtcaaaaaagtgaaatcgttaaaaaataaagctcgaaaaaccttaaaacctcttaagacaattaagagacaattaaaaagaaacctacacaaaaaaaactattctaattagtcttatagtagatagtacattgataagcagcctgtagccagttcgagataatcgactggcttttttctttgctgttcatttcatacaaaaaaacacctttaagtgtttcaacttaaaggtgtttttgtcttaattagatcaattcatcttcatgaggttcagtgagattatgtcctagcctttttatcgaacactacttccactacacgcttcgaagactctccgctctctaagtaacagaatttctcataaaagggcgcgaatgaagctggcaatgtaaagtttggctgttctgtttctcttacccagtcaatgacgctggctgtttctttcacaagaggtccaggtgcttcttgttcaaaatcgaagtagaagcccctcagcttgtcacgatatgtttcaatgtctggcacatagaacagcatcggacgtttgaggtttgcataatcaaagaacactgatgagtagtcagtgatgagcagatcagaaatcatataaaggtctctaatgtcttcgtaatgagagaggtcataggcaaagccttcatatggccctaaatcaaagttttcagcgactaaatagtgcatacgcagaatgatgatatattcgtctccgatagcggctctcagctcatgcagatcaaggtctaaatcaaatttgtactgcccctttttataaaattgatcgtctctccatgttggtgcgtataagatcaattttttatcaagcggcaggttcatcttttgtttgagtgctctcatcgtttcttcattgttttgattgtgaaggaagtcatttctcggatatcctgactcaatcatagtcttttgaaattggaaagctcgtgtaaagatttcggtcgaataagcatttggagaaatgagatagtcccaattcgatgcttccttcgtgaaattctttttgtatttctttgtgtttgttccaggcatatgaacttcatccatatccatcgccagtcgttttaatggtgtaccgtgccatgtctgcaagtatgttgtatgctctggttttggaacccacagcggcaaacggctgtttacgacccaatactccgctctcgccattgcaaaaatccatttcaatgacagacgattgatatagtagatgcccttttccttaaatggtgcttcatgcccttttttcacgctccagatcagcgtatattcagggtgattttctttcatatattcataaataccacgcgggttacaactgaattgttttccattaaagctttcaaatacaacagttttctttttgacagacattttactcgcaagcttaaaggtcgttttaaaggttctcgttacaagacgattacggacttttttaatcttgcttatttgctttttgaacttcttccacttgctcttcacatagtacttagcacgtgttttcattgtgtaatcattaattcggatgccaagcgtctgtctttttttctttcgatatacctcatatcgaatcgggacattgttcttcttttgtatttggacgagtccctttaattgtttagatcgatctccaaacacaagagatggtgttgttaaagtctcctctgttccgttaacttcacatataaattcgaagtacattctataaatatatctcttatctgtagaataggttaattcgtctaaaggtacttcaacattgaatggaaatatttctggtgtttccccatccgttctataagcatcaatatcactttttggctgatagtttacggggaatcgatgttccacttcgtcccttttgaacagaatttgaatttttttgattcgataagggtgctcagcactgatgacaccacaatatccacttactgtaagagaattggtctcatcaagtgataagtgattcgttttcgtgatcttcagctctcgcttgattttaatagaagcgttacctttatctgtacgatatggtacagcaaggagcagcgtgtttttattttctatgaaacagagttcagacatttcaacatccagctttagacgacacttatagtataggctgtcattttcacttatgactttgccttcttcctcttccaattcagcctcttcgtcatctccatcggaatcatatgaagagtcttctgtttcatcttcgctctcactactatctgtcattccagaaaaatccgtcacatacaagttatacgtttggccttgttccattttattcgggaaagaatcttcatgaatctctatttcaaactgattctccactagatgtttaagaggaaggtaaacttcctgctttgagaccctttctctcatgagcaagtaaaataatcgaccttctaatggtctctcatcatctatccttaacaaaattcttattttttggtcgtggttctttaaactctcaacgacactttttttctgaacggtctcttcaatcattaatcatttatctcctctgttcatcaaaatcttattcttatgcttattctcatacttataacacgatgtataataattaaaagtttctatcaattatttattcaccttccaagaataattccctttaattgtcttgtaagaaacaccgtcaactttggacacatctttttcattaaacagattctcggcaattggtaaacgcttaatgatttcattgtattcttcgtctctcattctaagatagaaatcaacatatttcgttttgtttcgtttcaatgcctcttgtatggatgcatgtccaataggaaaggataccttgaaattttcgactgctttagagaacagctcagcatggttgtgccgatcataaccgacaagttctaatataacctttttttgtttttcaataacacctttcatttgaatatccaaagaaagaacatgattctgaacatcaattcccactaatttcaaatgaataggttttatcatccgtttaatttggtctcttttttctcgaacttctatcatttttcgaagtgcctttgcccagttttcgtaatagttagggattgaatatatttctgcaatctcctgacaattttctgaaaaaatttgatactgttcatcgtttttcaacaattcaatgattttgttggctaactgtttcacttcatattgctcaacaacaaagccattaaaattatttttcacaagtgtactagcaccataatcgtaattataagtaatcacggggcaattgttaacaattgattccatgatagacaatggacagccttcaaagacagaggtggaaatagacattctagctgttctaaattcagcatcgggattttgagtgaatccttttaaaatgacattcttttctaagcttaatcttttaatttcttgttttaactgcttttcttgaggacctgaaccaaagatttcaagcctcgcatttggtacttcttttaccacaaattcaaacgaacggatggcatctatgacatttttcactttggttaatctcgccatcatcaaaaccttattcggatcagcagtatagtgatcttgtacttgatgtggtgaacgaccaagtgtatgtggcgttaaaaagaatatattttgatgaccaaattgtttcacaacgtctgttttttgctcttcagtgatgaaaaagacagcatctactttttgttttcttaattgggtaaataattcattataatcagaacgtaattctgtcttttctgtttcatagtgtttactgtgaataattgcagagaaataagtagaactcctttttttcaattggaacacatacttatcctgcttccggctatcaactaaaaagagtttttttcgatcatttttatactgaatagtcataagccactcttgtcttagtcctttttcatttttaaaggttttcattccttcttgggcataccaaatgatgtctctcaatttatttttagcttcgtctttaagatcatcatactcttttttcatataaatatgagtgttctcataaataaatagttctcgatagactttgcccgtttcctgagagaaataggaaactttatgcaactgcccttgtgagttatattcctctcgtttatccaattgctgatttggatgaaaataatcaaccacctcaatttgatttgatttttcattcctaataaaacgaacagatgaatcttcatcatcacataaccctttattgatgttgtcagcgtgataagttggctgatactgttcctttggttgacaatttggaataaggaaatcaacatacatattttgaatttttgtcatgttaggatccactattttcttgtcaataattcctttcactttctcaggaaattcttgatcatatgaaaaggttaaaaaatgagttgaagtattctttaacccaaataggttcgcacgtagcaataacgactttgtcataccaccatatttttctttaatttttccggtaataaagtaatactccatatcaggaatttgcaattgttgttgcggttgactttgattattttcatgtgtcttttttctaagcttgttaaaccattttcggatcaaaacactcaacctttcatagttgtccattattccgtcgatatttaaataaatttttaaacgatatgttaacataaaaaagcacttctcaccaaaagataagaagcactatcttaaataattaaagtccagcaatttcttccttaatttgtgttgttgagatgccttctgttcttttcaagtacacgacttcgcaatgctctttcaagaaatcgaatttaccttcccagtcatctcccatgacaaacacatcaatatcgtgctcttgcacgtcacggactttttgatcccagctgttttctggaatgacttcgtctacataacgaatcgtttcaagaatcagctttcgatgctcgtagctgtgataagccttttttgatttttgcaaattaaactcatctgtcgatatggccaccactaagtaatctccaagctgctttgcacgttcgagcagcttaatgtgcccccagtgtaataaatcaaatgtaccgtaagtaataactttcttcattgcaaacatgaactcctttcttcattccttattcaactgctttcatgcagtaatgtttatccgtaatcctatgatcatcgttcgtattttttcgctcttcggaacctcattatatcacagcgcctatcaaacgttaagcagatgtaaagacaaactatttccaatttattgggcggagaagggaaagtccgaagaatcaatgtttcttgcagcatcctccttatgaattgatgaaaatgtcatgaaatttaaaggtttgtaaagttattgttaatatttcatggagcatctgtgataaaatgatgtgtagacgaaaaacgaatttacaatgaacgttcatagataacaagataaaaaaggaggtctaaacaatgcaaacagaagtggtctctaacctttcttatgtaaacggcgacctagatgaatttattagctatatgaatcaccatcatatttctcaaagaagaggcgccatgattgcgactgtcaatccagagattggctatgctgttatgaaggatcatgcgtatcatcaagttgtctcctctgcggattatgttctgccggatggtgttggcgtcgtcttgatgtcacgtttgacacaaagtccgctgaagtcaagaattgctggctttgatgtcttcatgtctatgcttgaactagcaaacaagcagtctaaaagtatctttttatatggggcgaaaaaagaagtgcttgaggctgttagacagcgaattgatacggaatacccaaatgtggtcatcgccggcagctgtgacggttatcaagcagataaacgtttcgtagcaaaacaaatcgctcgctcgaaagcagatatggtgttcgttgctttaggttatccaaatcaagagaactttatttatgaataccgtcatttattcccgcaggctgtttgcatcggtttaggcggaagctttgatgtatttagcggaacggtgaagcgcgcaccacgatggatgattaaaacaaatacagaatggctgtacagacttgttgtgaatccatggagatggaaacgaatgctgaatattcctaaatacgcttttgccgtattgaaagaaaacaaagggaaaaaacgttactatcctgagcaagcaaaggatcagacgaaacagctgtgagagactgaccaatgatgaatatacgctcaatgatcatttcatgctatgcagctttcatttctttcattggatggctgatgagcggcgtgaaaccacgagaaaaccaggtgacgctgcttgtttcatttcaagagaatacagctgctcttattgatgcttatcaacaacaggcgaacatgacgatgaagcttactgtcctctatacgaagcatgcttctgcgatagaaaaggacgagtctcatctgtcatttcgctattttcatgaaaaaaatcctctccatcttattcgatgtatttatacgatgtttaaaagcaaggttgtcgtgacagataattactttcttatgacaagtgtactcagaaaacgtccttctaccacctgtattcaagtatggcatgccaatggggcgttgaaaaagttcgggcttgaagatgcttcaaattcggaacgaaatcctcgtgatattaaacggttcaaacgagtctatgcgtctttcgattatatcgttacaggctcagatcatatgcgcgagatttttaaatcttcgtttggggtgaatgatgaacgttttttaccaacaggtgtaccgatgacggatgtgtactatgaacagcatcagccttccttgaagccgaatgattttcctaaagggaaaaagatcctgctttatgcaccgacctatcgagactttgcaatggacggtcttgtcctgcctttttcaaaagaacaattgcaaacagagctaaacggtgattatattctgctcgtcaagcttcatcctgcggtcaaacatttagcgaaggcggaaacagacgatgaatggatatttgatgtatccgatcagccgctttatccattgctttgcgcatgcgatgtactgatcacagattactcgtcgatcgtgtttgaatatgcactgcttgaaaagcctgttttgttcttcacttatgacttagacacttatcgcaagaagcgcggtttagtcgatcgatatgaggacatcattcctgggaaagcttgtatcactcaagacatgctcttgatggagctgcttcaactaaccgaatcagataatcaagaccaaatcaaaaccttcgccgaggaatggaatcaatattcaaagggaaggtccagtgagcagctcttatcctttattgaacaacagctcttacacaaaaaacgtccggcttctcaataggaagcacggacgtttttttatttgttatacaccgggatatcgtaatacagcgtatagtcatcaagcaggttatacaaactatacatacgagtgacttgcttataagcccagcctatatctgttgcatattgatgagtcgctgcactagaccagcgcattttataaattgtatcttgtttgtatgtggcatgattgatatagctgttgccaatgaattttgctccgccaataatggcagcctctggcgtgaaccattgctgttcatacgcatactttgcaccaagatagttcggattgctgtcgtatgcgccaatgccatacatgttatatactttctttccattaaacatcgtcccattcgctaaaatggaacctccgttacctgtttcaagcagcgcgtgagaaatgagataaatttcgttgatatgatacgttttcgctgccgtaatgaatgcttgtcctttacctgcaagaatccctttgcctgctagaatctttgaattgacttctgcaggattgagattcgcagcttcagagagtttcaggaattgaaaataagattgcgtgccttctgcaatattagctgggtctacatatttttgcacctctgctgcacttgcatttctccagccaaggctgatcttgatccagtttccttctttcccaagctgtttcacttttgctcctttgttcagctgcgccacgatgttgcttgcagagctcgaatctggtgtcgaacggacatttaaaccgtccgtattcactgttgatgttgcttggtctacatatggtgcatagacataagccgcaccatctgtctgtggtgataccttcatttgtttgttgaccatctcattgacagtaaggttgtagttcgtttgcatgaccattgggccatttttgatttttacggctgtagctgtccagccatattgacttttcacaaaagcaatggctgcatttacagttggtaaccctgtgaattgctgtgtaatgttgattttgtaggttggtttcgttgttgtttgataggctgctggttcattccgttttttgaaaaatgccatgccttgatcgcgcaatgcagctgttgagatggcacctgttttgatctgatattgaccataatcagctgcacctgttttttgagcagctgctttcattttttgtttcgttaaataacttagcgcttgattcagttttgtctgattcaccgttggctctgtcgtgatccggtattgtttaaccgcttcagtcaacgtttttgtactgctggcaacgccatttttcttgataatctcttgagcctgcttgactttattttgctcatatacaggtgttgtcttgagactatacgttttgctgacagcttggcccttaccagttgtaatgctgcttgtcaccttctgcgtttttaaatatgcggcacctttatttattttggcttgctccgccgattgattgacgacaagtcgatacatgctgtcagatgctttacctgtttttttcgttgttgctgatacctttttcttttggaagaaagctgctgcttttttcgcttggtcatctcctaaaaggtttccagtcactacttgatatggctgtgtagaagagatcttttgcgaagtgtagcgccatttctttttcttgaaaaaggccaccgtttttccgtatgctgtatcgttcagttgattgagcttcacgatataattttttgtttttcccactcgctgtacagtccctgtagcgccggtttgtttcttaatctgggccgcagctgaggatgcctgtttgttgtctttgaaatagcctgattccaagcgataaacattttttaaagcgcctgtcttttgaatcttcccgctgatctttgcttctctttgaagctgggtaagaagcgtctgtgcttttgactggttcgcttgtgcagctgatgtgacgatgtaatatggcttgcctgctgtcaccgtttgaagcaccgcttttaaaccagactctttttgaaagccttgcaagatcgtattcgccttactttgcccaacgataccgcctgaaatcagctgatacacagtgcctgctttgttttcagtttggtatgtactagtgacaccggcctgcttttgtaattcggtttgaatatttttgactttcgtttcagaatcaatggttcctgaaatgacctgataagaaggtctgctttcattgataacttcataggtgctattgagtcctgaggttttcgttagctcgagtgagagctttttcgcctgaacttcatcattgacggggtcagatacgaccttttgtaatggaaggcggtcacctactggagacaccgtaccgctcatgcccgtctctttttttaatgcagctgcacttgcactcgctgctgcttgtgactcatatcctgaggcagtgagctgataggtcgatgtgtttcctgaggtttgataagtggctgtccactttttgtccttcttcaatgtttccactgcttttttcacttctgactctgttgtaaatacttttgaggtgttcatcgtataaatggattgatcgacataggaggctgcttgcgcttcattgcccgtctgtactgtcataccaaaggcagctgcgagtaacataatcttgatggtttttttcacgttcactgtccctctcttaactttgcataattgtctactaatctctttatcgacaaaaacaagtactctttcaagttatttatgcaatagaaaaatagaggacccctttgaagtcctcttttcctttatatatgcgatacaatcagttcacaagttccttcaattgagaagttccctgtttcagccggcaggataaaatgagctcctttaggcagtggatatgtatgcccatcatgcgttagagccccttccccgctaattacactgcacagcaaaaacggataatcttgcgaaagctctactgcttgatcaatttcccatttatacacagagaaatactctgcttcaacaaaagttcgaatggtcagcccacggcgtgtttcaactgattcatctgcataaccatctacatgggggaccgttgtgacatcaatggcttgcgcaaaatgaagttcacgttcatggccattctgatcttttcgttcataatcatatacccgataggtggtatctgagctttgctgcgtttcgaggacaagcgttccttcgcaaagcgcatgaatggtaccgcttggcacataataaaaatcaccaggcttaatcttcacacgacgcaaaagtccttcccaatctccactgttcatcatggtcacaagctcagttcttgttcttgcgctgtgcccatagatcatttctgctccttctttgcagtcaatgatataccagcactctgtttttccaagctcgccattttcatgtctttccgcgtaatcatcatctggatgaacttgaacggacaagtcctggtttgcatctaaaattttagttaacagcgggaatcgatcgccttctattcccccgaacaattctctgtgattgtcccatagttcgatcagcgttttccctttatatggaccgtcttgcacgacacttggtccgtttggatgagcagaaattgcccagcattctcccgtttgatcagaaggaatatcatagccaaattgatctcttaaggctgtacctccccatattctctccttcaattcaggcagtaaaaaaattggtgactgcttcattcaggatgactcctccctttgctaccctttgataatccttgtaaggcttgatgaaaactagcaagtctcaacttttattatgacgctatctaaagagaagtcaatcctttcagtacaccaaatgaaaacgataacacgaaaagatttcatcctttgacagagcctgcgagaagccctttgacaaagtattttccgagcagtatatagaccaaaagtgtcggcagtgcggccaatattgcccctgccatttggacgttccattgcacaatttgactgcctgatagattttgcaaggcaaccatcaccggctgatgctctgcagtggtcatcgtgactgcaaataagaactcattccacacatttgtgaactgccaaatcgcgaccaccacaaatcctgtgattgaaagcggaagaatcatatgtctgaaaatcccgataaaccctgcgccgtccatttttgccgattcaatcatttcatcaggaatgctcacatagaagtttcgaaacatgagtgttgtgattggaagtccatatacgacatggactagcaccaaacccggaatcgaattgtataatccgacttcacgcaaaaattgaatgagtgggatgaggatactttgatatggaataaacatcccaaacagcattagagtaaagactacttctgatcctttgaaacgccattttgataggacatagccattcatcgcccctaagacagcagacaataaggtagccggaatgactagataaagagaattcattaaattgggcgctagcttttcaaatgcgatttgatagcttgaaaaatcaagtgttgacggcagtgcccacattttctcaagggtcacttcacctaatggcttcaaacttgtgacgagcatgacataaactggcatgagaaaaaagagactgcacaaaatcaataaagcataaagaactggacggacaaaccatctagctgtcatgatgacgcccccttccggctcgacaggagatatggcacaataaagaccgcaactgagatcagcatcacaatcgcgatagcggcaccgcccgcataatggtttcctctaaaggtcatttcaaacatgtacacgcccggaacatctgtgacaaagtttgcacccggtcctgtcatcgagtaaatcaaatcgaaaatctttaatgaaatatgagccatgatgataatgacacttgcagttatcggttttaataaaggaaaaataatcttccggtaaatctgccattcggttgcgccatccattctagcagcctctcttacttcctctggaatgcctctcaaacccgccaaatacatcgctagagaaaatccagtcatctgccaaacagctgcaattacgactgcaatgattgccgcagggacaccaaactcaattttcccccagacaaatccagctaaaatattcgtatccgtgtaccacttaggctggataccaagcgtctttaaaaacagattcaccccagtggacgggtttaaaatccattgccagacgacccctgtcacaacgaaggaaagggccattggaaagaaaaataaattccgaaatagagattcacccttgatcttttgatctagtaaaattgcaagtgcaagcccagaggcaataacggctccaataaagaatagagtaaaaaagaccgtgttccgaagatctgactgaaagcggaaatcttgaaacagcatcatatagttttgaagccctgcgaaagagaaatcaggaacaagcgaggtccaatttgataatgacacataccctgtccagccaataaagccgtaaacaaagatgaataataacacagccgacggggctaaaaatagaagcgcaagcagctgatccccactccattttttccgaacacgtttgactttgggtgttgatgcttttgtgatcggcgatgtatccatgcgcatgaagctacactcctttttaaaaaagaggcggtgcttagtcgccgcctcctcgtctttatttcattgaatcttttaaagatgaaacaaactggctgctgtctttttgtgtgacgaagatattgacggcttgattcgcttttgtcacaaacccttcttcagcagctgaaccatgcgcgagagacggcgccagctttgattctttaaatgccttcatcgccgattttccgtattcatcatatttagacatatctgcatccacacgtgccggaatcgatcccttcagcgggttaaatgcatcctgtccttccacagatcctaagacagataagaatttcttcacgttttctggctgtttcacgccctttggcagtccaaatgtatcggtgatcaccataaagcttccctctgtatcaggagtcgccacgtatccgaagtctttattcaccttcagatccagatcattcacaaagtaccccttcgcccagtcgcccatgacgttcattgcagcttccccttttgctacgagctgcgaggcatcctgccagttacgtgagctgtggtcatcattgacatattcaagcatacgtccaaagatgtctgccgcttccttcacttttgcgtcatccattttcatgtcgccagcccaaagtttttgatatccatcagcgcctaaaacgccgagcagtacactctcaaacaaatgtgttgctgcccaaggctctttatccccaagcgcaagaggtgtaatgccttttttctttaaagcatctgctgttttgaaaaattcatcaaaggtcgttgggggctctaaacctgcatcatcaaataccttcttgttataccaaagcacattgcctctgtgaatattcaccggtactgaatagattttcccatctttgctgacaaggtcgatgagtgattccggaaatttgtccttccagccttctttttcatatagatcatccagcggctccattttacctgctgcgacccagctctcattcagctccgctccgccatgtacttggaatgtagctggcgggtcatttccttgcatccggctagtcagaacagcctttgcatttgtaccagcaccacctgcgacagctgcattttcaattggaatatctttatttttctcttcaaacaattgaatgagtgctttcagtccgtcctcctcacctgctccagtccaccaagaaaaaatgtcgagcttctctgctccgccctctttttttgcatctgagctcgtcgatgaactacaggcagtgacgataagcatacagagcactaacagcgtaaagcctaatttaaccttcatgattgatcccccatccctattttgtaagcgttatcatcataagtataatggcagatccttgctttttttcaggcaaacttcttcacttttttatgaaattcttcatttttttacggtctgttttcgatattccttcggtgaacagccaaccatcttcttaaacacacggctgacataattagggtctgtatatcctgcctgataggtaatttcttttaaactaagcgagctgtctttgagaagccttttgattttatccagccggcaggcagtcacatactctttaaatgtcagccctgtctcgtctttaaacctttttgtgaaataggtcggacttaaatcaacataggccgcagtctgttccagcgtgatctgttcacaaaaatgcgttttgatgtagcgctttgcccgctcaatatcattcacagtctggtttcttgcttcatacacgtcaaataaatattcacagcactggcggcattctgctgcggtgttgatcgttaatataggccagtctgttcggagtcgtgatttaaataagatcagcagctcttttagttgagacagggtcgccccctctagttcaaaagcatcgaataaagcgagcgcctcctctcttctcccttcttccattgcctgcatcatatcgtctgcaagctcaggcagatggatcaatggatgggaatgttcttctgtttggtaaaagccataacgaacaacgccaggactctttttccgctgataataggaaagcttcgcctctgctgcacttttctgaagataaagcggatttgagaccgggtgtcccatgccaacgacaggtgaaggctgatcgttggttgtggcagttcgaatcgcctgcaagacatctgcctttaactgaccaggcgcttggtgacgataaatgagacatgtaaacagctcaccactcacctgaatcggcaccgtatgaaaaaggggagatgtctgtaaatgaatcaacaactgattcccgattgtccgctgtacagcgatgacaagacctgcttcgaattcatgaaacagttgtcgaaactccgcggaagtataggattgtccgtttatgacatgagcttcaagccactttgactgctgaccggccgccagcgcctgccgctgagacgcctcctgctgaatctctgccgcaaccgttcgaatggcggcgatggtttcatctttgtcagccggtttgatgagatattgtttcactccttcctgcatcgcttgcttggcataatcgaacgtatcgtaggctgtcagcataataaattttgtatgaggactgatcgctttgatttgcttgatcgctgtcaatccatccattccaggcatctgaatatccatgagcacaagatgaacgggctcagtccgcacgaattcaaccgccttttttccattttcagcttctcctgcgatatgacactctggaagccaatcggtcatgaacttccgcatcgctagccgttctatcttttcatcatctacaatcagcacgttcagcatgccggtccctccttcatcggaatagccaattgaatagtagtgccttcgtttggatttgagtcaatttgaagggcatcttgtaccccataaaacaaacgcagccttgacatcacatttcgaagaccgattcccgttgaatgccctttactcaacatgtttggatcttcctcttctttttctgatagcaatcttcttttctcttgttcattgattcctatcccattgtctcgaatccgaatcatcacatagccgcctttttgatagatcgagagctcgacaagtccatcttcctcttttggttcgacgccatgaataaaggcattttcaacaagcggctgtaaggtgagacttgggatacgtacagataaacacgattcatctatggtcgttttgcatgtgatacgatcggcaaatcttgtttcttgtatatgaaaatattctttgaccacttttacttcttgttcgagcgtaacggatgcactgagagctgacagcgaataacgcatgagagtggaaacagattggatcaatctcgatgtggcatccgctgattctaagtaagccatgcgtgagacgatgtttaaggtattaaataaaaaatgtgggttcatttggttttgcagcgttttcagcttcatgtctttgattttttgatctaaagctgccttttgtttcatctcttcaatcatcattttcatctcttgacgcattcgctggaaggcctcatttaatacagaaatttcatcctttgaggtgacatgcaagtccgctccatcaaagtttccttctgatacttcctttacgcttcgagagagatggacgatcggtcttgatatcccgccagcaatcatatacgccatccataatgcgactccaatggacagtgtaaacaaacatagggtaaagagcgcataggtttggtgtcttttttgcagagattgatagagtacttgatactcagacaattcatcatcaagcaaggtcattgtttgctcttgtatgtaggaggagacggttcttacttccttcacacttgctgcatattctttgatttttccttcttttacatgtgtcatggtcgcatcactctcattgatgagcgtccgcatcatatattgatatttttcaatagaaggaattgccgcatgaagcccggcatcttttcgcaatgtctggtcgtaggatttcattttttgttttgaagctagatattctttggcaaactgctgatccttttcaatcgcatacgcattgaccttttcatacatcgtttttgcctctgtcgatatatcattaagcaggagaaaagaacgaaagcttctgctatattctgatacgatattcgagctgctccaatagacgaaaaaagcggccacgttgccaaggaatacaagggttaaaaatgccagtaacaacttacttcgaatccttctcacggctgcaccccctgccttctgtctgtttgctgtagcggcagatcctcttgccgaatcacactcgttcctgtgtactgaagcggctcttctttttcacctttctgcaaacgcacaagcgattccactgcttggtagcccatttcataaggatgctgaacaacgacggcatcaatctttccatcatcgagcgcctgaatcgtatctggcaatgtatcaaatgcgagtacatagacatctgtggacgatcgatattgcgctgttgcttgaatgatacctgcaccatctaatgcactcgtgccgtaaaatgcagtgagctttgcatgatcgtttaatagtttatatgcggcaccggaggcccctgattttgtaatggctgattcttctattccaacaatatgaatgcgttttgcagcggcgacggcatctcgaaatcctttgacgcgctgcttttgatgaacggcatcaagcctgcctgtgacaattcctacgtactgttcgccttttgtatctgcgatgagtgcctgtcctgcgataaagcctgaataataattgtccgtgcctacatacacttgacgcatgctcccctctgcatctgtatcaacggtgacaacatcaatgcccttttccctcgccttctgaaaaagcggtttgtattttttcgcatcaagtccctgtgtcataatgccatcaacatgccctgcgattgccatatcaatggttttcaaatgatcatctatatcggcttgcttcggacccaaatattctaaatacacgcgatgagcggctgccgcatcagcagctcccttttggaccagctgccaatattcattatcaagttcctccggtacaaggacaaagtgatattgataggttgatgacgctttttcggaagcgctttcaattttaaataaatcttgacctaatgatgttaaaaaaatgacagatacgacacaaaaagtgagaaaggtgcccaccccgatccactttgatactttcaccacatcctccccctttcaaaaattgcgcataaaaaaagagctgcttataagcatactctctcgacctctataattcctttgtcataaataaactgtttggatcttcttgatatgaaacgaaaggcggacaaatataaaacccaacactctcatatagttttcttgctggctcaaagaaagacatcgcacctgtttctaagctgacacgtgaataaccgcgcctttttgcctcttggagaagatggttcagcatatacctcgctacaccttttcgcagatggagagccgcggttctcatggatttgatttcaccgtgctctcttgacagctcctttaacgctccgcagccaagaagctcctctccatcccgtacactccacactgtgacatcttgctttttcaaatcagctaacggaagggcatgaatgctttctggcggggaatgctctttcatttcttctatatgagcggtaatcagctgttctatttgtccatccgtgagtgtatcttgttgaatgtacacatctatcactccttcacgatcattgtacgtgaagagtcagtattcaccagctgttatgtcagataaacgaacaaacaaccagcattcatctgccagttgttcatttgatagcacctatttatgaagaaagaaccgcttgtaattcttctgccgtactgctttcaagctgacttccgatccctactgccactgcgcctgctttcagccagtttggcacatcggttggatgaatacctcccgttggaataaattcaatgtctggaaatgggccttgtaagtttttcatataggataaaccgaaggagccacttggaaaaagcttgagcaagcagtatccagctgcttttgcctgcatgatttcacttggggtgaggacacctggtacatagagtgtgtcgtgaaacgagagatgctctccaatgacaggaagatatcctggactgacaataaattgtgagcctgcgccaatggctgactgcgcctgctgaagagtggtgattgtgcctgctcctacaattagatcttgctcatgctgaaaagatgcaatgatgcgttccgcattgggcgtggtatacgtcacttcaatggctcgaacgccttttttctttaaacgctcaatgatctcaatgccttctgcttcgctccccgctctcaccactgcgatcagcttacaagccgcaagacgctctttaacgctcaaacttgctgactttcccatatccttcgtcccccttcatatattcccgtctttgatatcgtttggctcccttcataaaagcctgaagctcttcccgagtaggcagaccgtccttatcgcctggagacatcaccgcaagagcccctacagcattgcctcttgtcacagatttttcatatgataaaccgtccaataaaccactaatgacccccacggcaaatccatcaccggcaccgactgtatccacgacattgggcacataaaagccgctcacaatcccctgactggctgcacttttataaaaggcaccttctgcaccgagcttaatgaccacaagcttgacgcctttttgcaaataaacatctgcaatctcttccggctcgtgacagcctgtgagcctttgcccttctgcaagccccggaaaaaaccaatccacttgaaaagctatctgattcactgtatggatcatatcttcttcctcttcccatagctgcagccgaaggtttggatcaaatgaaatggttttgcctgcctctttcatcttttgaagagcatgaaaagagaacgctctcatttcattagataacgcaggtggaatacctgtcatatggagatgtcctgcctgcttgaaataattcacgggaaagtcgcttggactcatcgtgctcgcagcagagcctttccgataatacgtgacatcaggatctccatctatcactttggatttaagtaagatccctgtttgagccccatcatttgaacgaatcactgcacttgtatcgactccttctttttgaagctcttctaaaataaatgtgccaagtgaatctgctcctactttactcatccatcccacatcaaaacctagcctcgctaaaccgactgccacgttactttcggcaccagcaagcgccttttgaaatgtatgcacttgatgaagctccccgacttcttttgcgtaaaacatcgccattgattccccaaatgtgaccgcattcaatgctttcactcatttctcccctttcatggtaccggtttcaaattagttgaaaaagagagagcatgcacgtatgtatactcttctctgtctgttgtttataaggattttcttgcgatgatttctccatcaagctgaatggtttggggcgcactttcatccccttcaagccgagtcttgattttttgcatggcggctttccccatttcatgagatggctgggcaaccgttgtgattccaggcccaatcagcttataccattctgtatcatcaaaacctgcaatgcctatatctcctggaatctttaatccgaggtctacaagctcactaatcagcttcagcataagtaatccattggctgctaaaatcgcttttttctgctggtttgattggacaaaatggacaagttcttctcgcagttgttccttttgtttcaaatcaatttctacaatgagcggcttcttatgtttactcatggctgtctgttcatatgcttcttttcgttcttcacgaggactgatcccatcgaccggctcagtaaagaaggcgatgtgctcatagcctctctcatacatttgttgaagcaactggattgtgatatcacggttattcgttgtcactgtatcgacttttagttcaggtaatttccggtcaacaaggacaatcggcacaccgtttttcttaaaatcctgcagaatgtcattgttctggcctgtcgtattgatgatgagcccttcaatataatgcgcattcagcttgaggagcatttcgcgttctttttctggccggttatctgtattgcataccataatgctgtatccatattcatcacaaatttcttcgactccgcgaagtgtggcaacagagaatggatttgtaatgtcggctacaataaacccaatgaccttgctttttcttactttcaatccttgagcgagctgactcggacgataatgcagttcttcaatggcttttttaatttttttgaccttttcaatagaaatttcatttgttctgccattgatatatctggatacagttgattttgaaacacctgcataatcggccacttcgttgatggtcactttcgtttgctttttctctttcattcaaaaaactcccacaatcaatgtcttctcatttgtttcgaaaccgatttcaaataacttaaaaagagcatatcataatttcttgtattccagaagatttttttgcttgaagatggcaaataatcatttaaataaacaaaaagaaagcgatttcaaaataacggttgacgacactctctttttcctctaaaattttccttgaaaccgataccaaataaaatacctacattttgtttcagatggaaagggaggcttatttcaaatggaaaatcgttatgctgtacatcctgagcaggtcaagcgttttacaacagaggaacttcgtcgtcattttcatattcctacactattcgtcagcggtgaattgaagctctactattcgcatgaagaccgtgtggtgattggcggggtcatgccgtctgcagagccgctcaaattagatgccggcgactttctacgtacggagtatttccttgaaagacgcgagatcggcattgtaaatgtcggcggtcaaggaacggtcactgtcgatggtgaagcctttgtactgaagcacaaagatttcttatatattggacttggacacgaagatgtacagtttgctagttcatcaggcgaagaagccaagttctaccttgtatcagccaccgctcacaaagcgtaccctacgcaaaaagcagccatcgctgaattaacaccgaatcacttaggggaagcgtctgcttcaaacgtacgaaacttgtatcaagtcatccacgcaaacggtattcaaagctgtcagctcatgatgggaatcactcaactggaaaccaataacacgtggaatacgatgcccgctcatattcatgatcggcgtatggaagtgtacttatatcttgatatcgaagaagatgctcgtgtctttcattttatgggggagccatctgaaacaagacatctcgttgtggccaatgaggaagcggttatttctcctgcctggtccattcattcaggttcgggtacagcgaattattcatttatttgggcgatggcgggcgagaactatacgttcaaagatatggactttgtcccaatggaccagctgaggtaatgtgatgacgacagcatcctatgtaacgtccctcttttctcttgaaggcaaaacagcccttgtgacaggtcctggaaccggcattgggcagggcattgctgtggcgcttgccaggtcaggcgcagatattatcggcacataccaccacacaccgctagaggaaacgaaagcgctcgtcgaacaggcgggccgctcgtttcatgcggttcagattgatttttccgaccctcaaactgcaaaacaggctgtcgatgccatgttacaaaagcatacgatcgatatcttaatcaataatgctggcaccattaaaagagagcaggctgctcattattcagaggaggactggcatacggtcatggatgtgaatatcaatagtctctttttcctcacccaaagggttgggcggcagatgctgaaaactggtcaagggaaaattgttaatattgcctcccttctatcatttcaaggcggcgtctttgtccccgcttatacagcaagtaaacacgcagtcgcagggctgacgaaggcatttgcaaacgaatgggcgaacgagcaaatacaagtgaatgcgatcgctcctggttacattgcgaccaataacacgcaagccattcgggacgatgagaatcgaaatgatgagattctcaaacgaatccctgccggtcgctggggaaagcctgaggatctagccggtgctgctgttttccttagctcaccagcctctgattatatgaacggtcatattttagctgttgatggcggctggcttgcgagataaaacagacgagagaattcctatttgcagggattctcttttttctatttgcataattctccaccatccgagtcactctatagaaaacatgacatgagggtgaggtattatgaaaagtcgtattgaacaagatatagcgtccatcatcaagcgcgtcaaaagctttgccgggaaaagtgatgatatcgtgttccactcattttcatttggcccttctgctatctctgcatgtctcatgtacattgaaggactcacagaatttgagatgctttccaaacaaatcatttcacctatgcaaaaggagctggatatcaccgaagttgattctagtacgcttccagcgctgtctaaaacgttctttggcatccaaaatgacgtgctggaggatatgaaccttgccatcgaacagttatatagcggcagggctattttatttgtagatggcgcgtctcaagcacttgcactccaaacgaacctttttcaatttagagaagtagaagagccacaatcggaagtccttgtaagagggcctcggatcggttttattgaaaatcttgaaaaaaacacggctttaatccgtgagcgggcaaacgacccaaaccttgtcattcaaaaggtgaatgtaggtactcgcaataaaaagtccgcagcccttgtgtacgttcgtgatattgttgatcccaaattagtagaagatgttttagcacgcatggccgaaatcaaaatggatgacatccctgaaaccggctatattgaacagctgattgaggacagtcacatctccatttttccacagattcaaaatacagaacgtccagaccgggtgattgcatctgtgcttgaagggaaagtatcgattttactcgatggcactccttttgcgctcattttaccgatgacctttacagccttgatgcaatcacctgaagattattatcaaagatggactagcgctacacttttacgtttactccgttatattgctgttttgctcacgatttttttacccggactttacattgcacttgtctcttatcacccaggcttattacccacacgaatggcactcaccatcgcaggcagtcggcagaatgttccgttccctcctgttgttgaggcgattctcatgtcttttacgatagagctgctgcgggaggctggacttcggcttcctagagccatcgggcagacaattgggctcattggcggcgtcatcattggtcaggcggctgtccaagccaatatcgtcagtgccttaatggtgattattgtgtcgctgacggcactagctgactttacggcaccgtcctatgactttagtttcccgctgcgcattttgcggtttatggccattttcagttcagcgatgtttgggttatatggcttaatcatgtgttatttatttgtgctttgtcacctgatgcaattaaagacctttggttttgactatttcacacctgttttgtcttcaccgttttcagatttaaaggatacgtacgtacgtttaccaattgggctatttaaatcgagaccgaaaacagcaaaaataaaaaatctcaaaagacaaggagattaaccgatgtacagagctgagaagctatcattgttacaagtcaccattctgtgcagctctacaatgataggcgctggaattttaaccattcctcgcagttctgccaattcaggattccctgatggctggatcattgtattactacagggagtcatctttgctttcgttgcttttttgttaggatggattgctgaaaaaaatgcgccggataccatttttgaatcaaatagaaaaggagccggtgcaatctttggcacattcttcaatttaatactgattgtctatttactaggcatcgtcggctttgaagcgcgtgttctcggggaagtcgtccaatttttcctgctggaatcgactcccatggcagtgattgtgatgatttttcttctcgtggcgatctatcatttgaaaagtggtatttttccaatagtcaaaatggtgacatacatatatccgatgacgatgattatttatattgggctcatgctgtttagtttgaaaatattcgactttgattacttacgcccagtgatggcgcacgggtttaaagatttcagtaatttgttctctcaaacatttattcaatttacaggctttgaggtcattttgtttgttgtaccgctcatttataaagacaaatggtcgaaagcaaagtgggctgctgcgatcggggttggaatgacttctcttatctattctctcacgctctttattgtgattggttccatgaccgttggagaaacgaaatccctcacctggcccactgtctcactcattcaagcactagaacttgaaggggtcttcattgaacgatttgatatttttttactgacgatctggacgtgccagcagtttatttgcatgcttggctttttccaatttgccattaaaggatgccacacagtctttaagacgaccaatgtaacgagactgctatggctgctgtttttgattacctctgcgctctctttatttccgagaaatatcaatgaagtcttttactactctactttactcggctacgcgttgttcgccgttttagccattccttttattacagccattctgctgatgatacgcaaaaaatggggaggtcgttctgcatgagaggaagacgtgtactgtttatctttttgtcctgctgtcttttccttctatcagcaggatgctgggacttaaaggatattgaaaaattatcatttgtgcgcggcgttggaattgatgaggaagatcagcaaggagtcaagctcacttaccaaaacctagtaccgaagatgggcgggacacaagaggctgattctcctggctatgtaaacgtcgtctcgaaggggaaaaatgtactggaggctgtcagtaatgtcgccttaaaggatccgccaatctatagtgatcatctaaaaatcttcctcttcggcaaaaatcaggcggagcatcacgatattcaaggaacgctcaatcattttattcgagatgatgaagttcggcgaagcagctatctcctcgtatcacgcgatgatgcatcaaaagtgatcaatcaaaaattgaaatcacagcaaaaggttccagttgagcatatctttgaaacatccaaaaaccgaaactttaacgggaagattttgctgccaacccgtattggccgggcatctgattacttccagatgggcgttagcttccttgttcaaagtgtagatgcgatagacggcgaacttatctatgatggggcaggaatcattcacggaaaaaaccgaaagctgatcggtttcatccctgcaaaggatgttcaatctttaaattgggtgatggaccggatctcaggcggcgttgtacctgctacctacaaaggctttccgatcacatacgaaattaagaaatccaaaactaagattgaaccttctctgaaagatgggcatatttcctttaaaatcattgtcaacacaaacggaaagctttctgaagatcagtatcctccagaaaattcatacgatgaacagtacatccaaagatttgagcgtctttttgcaaataaaattaaacaaagaattcaaaaagcggttcatcatgtacaaaaagaggtgggcgttgatcccatatttttaagccggcagtttcgtattaaatatcctgactattgggaaaagcatcgagacgaatgggatgcgctctttcaagaagcggatatcgaatatgaagtcaaagtcagcatcttgaactttggtgcagaaggtgcaacaaaaagctttaaatggtaaagcaaaaaagcggttatcccgaaggggagccgccttttttgcgcacgacaatgagaagctgatacaaggtcacttgatcagtcaacgcttttgtttgaaagccaagtgacgctcctactcttgccacctcatcaaaaaacaattcgacgttttgatcaatcggaacattgatcctcttctcgatcacccgttcaaacaaatgatctgggaaaagcgcacgcatggtgtttggtgtgaagaacctcaggtgacctcggtctaaaattcctacatcttgatacgtaaaatcaccggtcattaacgggagaagcacctccgcatgcatcatgtttggcagacagcaaatgatcacgccgcctggctttaaagatgcgtgcgcttgttcaatcatgtgccaaggatctgacacatgctctaaaacatccgaaaaaatgaccgcatcaaaaaaagcctctttctctaaccacgggtactcatctgcttttgcctcaatgacttctttgtaatatgcctttgcgatggctgctcttaatggatcagcgtctacgccgtacatgtcaacagtctgccgattcattagttcaagccctgttgcccctgcgccgcatcccacatccagtacacaggcagcatcttcaggcagcagagccgcaaagtatggatgaggggtcatcagattgaggtcaatgccccatttatctaaaaaccgcagcctgttctctgcaaacaatgtagagatgttcgtttcttgattcgctcgaaaggttgcatgaccgtgatgatgcacaaatgaatcgtgaacgatttgaagctgatatcccttcagtaaggatctcaaacaaaggtcgtcatcctcaaatgatccatacacgaaccgctcatcaaataaacccaccttttcaatgagctcttttttcacaagcagacaaaaccccacaagccgatgtacataagttctctgaccttttttcgcagccgtataattcttcgcaaaggctggcagttccttcacatctgtatacgctggctcaaccatttgaggaccgctcacatagttggagactggtcctaccatcccaatgcgttctgatgcaaataacgcctctcttaatggagaaagccaattttccgtgacgatcgtgtcgttatttaaaaaaagaatgctatctcctgccgctttttttgctccttgattacagccttttgcaaagcctcgattttcttcattttctatgaaaatcacatcgttcagctctctcacatattcctttgtcccgtcggttgacgcattatcaacgatgatgagttcatattggtcacttcgggtgtgctgcttgatgctgtcgatacattttttcgttaaatgcagttcattgtatgtcaggatgacaatgctcgttttccctttcatctcatttccacctttcgcccgcctgttccatatgtatgtcgtatgcagcacgttcagaagatgagagattgtcctttcttgattaaacgtttgtttaacaaagaaaaaccagctgcatacgggcagctggtcattgttcacaccgtttttccttcgtcacctgcgacggcacggtttctcttttttaaatcttcttcaatttcttcaagacttttccctttcgtttcagtcaccatatatttcacaaacaagaaggcgcctacgccgatgaccgcgtaaataaggaaaagattactgatacccatcgcgcttagtaaagttgggaatgtaagcgagatgattaaatttcctgtatgaaggaggaaggtagagacacctgtaccaattcctcggacatgtaccggaaacagctcaggaagcatgacccaaacgacaggaccccagctgacagcaaagatgacgataaagagccctaaacaaataatagtcgtccatcctgcagctgttgacccctcgaaaaatcgattgaccactgacaggacaattaagcttaagaccatgccagcattcccaaataagagcagcgctttgcgccctacacggtcaatgattttaatcgccacaaacgtcatgacgacattcactgccccaattccaacggttcctaaaatggccgctgaattaccaaagccaacgcttgtgaatgtttttggtgcatagtaaataatcgtattggtaccgataaactgctgcagaaaggcaagaccgaccccagcgattaatgctgggcgtacccatggctcaaataattccttaaaaccgcctttttcttcactttccgcctgctgaatatcagaaatttcttcttccacttcttgcttactctttctcagtttagataatatctcttttgcacggtctgcctgtccatggacaaacagccagcgggggctttccggcataaatagaatcccacataataaaagcacagaaggaacaaccgcaattccaagcatgaggcgccatgcttctgcatctgctaaagcgtaattcacaatataggcgagtagaataccaaatgtgatcatgagttggtttaaagaggacagtgctcctcgcgattcctttggagcaagttcagatagatataatggaacaatcgttgtcgagcacccgacagcaagccctagcacaattcggaataagaccatcacttccgtattcggggcaagagctgtaccaaatccgccgataataaacaaaatcgctgcggcgatgatggcttttttccgcccaaattgatctgtcagctttccagataaagaggaaccgagcatcgctccgattagaatcgagctgacaacaagtccctctgtaaatgcgtttaaccctaaatcctctttcataaataagatggcgccagaaatgacacctgtatcatagccatataaggcgccgccaagtgcgccgaagaaataaagccagccattccgatttttcatgttcataacccctcttttgttctgtatgtactggatgtttctctatggaaaatcattttcctcactttctgtcacttcaaacatttcgatgttttatgacaaatatatttcatttgcgtatcattgaaactttttacgataagaaaacgtcaattaagcgttagtgaaaaaaatgtcgcactatatcccgttttaaggtatatttgttttagtttgtaagcaaaaagaaggacatctttactataaaaatcatagcgagggtttaaaatatatggatcaatcaagaagcaaacgcaaaggaaaaaagcgtttaaaaccatgggtgaaagtcactctatttatagtcggtattcttttactgacaaccgcttctgtcacaggctatgcctactataaagtgacaagcgctgcaaaaaaagcacaagtatctttagatcgcggcgcacaatctgtcaaacggattgaagcttttgatcctgggaaagacagcttttctgtcttgctgcttggcattgacagcagaccgggtgaaacagtgaaacaagcacgaagcgatgcgatggtcttagcaaccgtcaatcgtacaaataaaaccgtgaaattattaagcattccaagggactcatacgtgaatattccagggcatggctatgacaaaattacacatgcacacgcatttggcggtgcagatttaaccttaagtacagtcgaagatttactagatattccggttgattttgtgatccaaagtaatttcaaagcatttaaagagatcgtcaatgaactaaacggggtctctattaacgtcaaggatgaatatgtggttaaacaggttctaaaagatacaaagggcaaggtacagcttcaaacaggtactcatacgctagacggtgatcaagcactcgcatatgtgagaacaagaaaagcagatagtgatttaatgcgcggacagcgtcaaatggaagtattaaaagccatttttgataaatcaaaatcgttaacatctattccgtcatatgacaatatcattgatacacttggtgataatgtggcgaccaacctttcaatgaaagagctagtcgggcttttcccgcttctgacgtcattgaaatcggtagataccatccagctgaaaggctctgattaccagccaaacggagtttattattaccaattagatcaaaaccagctaaacgaagtgaagactgaattgaaaaagcagcttgaattatcataaacagaaagcgtcgctagggggcgctttttcttattgacaatgatgcagattttctccctttggcttatttccttgatcattcgttcatttttgtttagccttgtagagaggatcaagcatcgtattgctcatgagaataaaggaaatcgtacatactttgaagaggcgattgcatgcatgaaggaggatttgacagcgatgaaaaaaatgattgcgattgatttagacggtacacttttaaatacaaaaagtgaaatatctgctcaaaaccgggaagcattgattcgtgcgaaggaagcgggatatattgtcaccatctgtacagggcgggcgacttttgatgtgaaggaactgcttggcgatttggacattcctattattgcagcaaacggcggaaccgttcatacagaaggctacaaacttttcagccgcatcacacttgaccaagaagcaggaaaacaagcggctagggcattagtagaacgaaacatttattttgaggtctacacggacgatgcgctcctctctccttttgatggaaaagagaagctgaaagcagaatttgatgtgatcaaaagtgcgaatccaaatgaggatatagctgatttatgggaaggggcaatgactcaattcaaacaatttggcatcaaaccagtggatgatatccgccagatttttgagtcgaatgaagcaacctataaattactctgcttctcatttgatatgaacaaactacaggaagcacgaaatctcctcgcggaaatgcctgagctttcattgacctcttctggaaaacatatcattgaggtacttccaaaagagtctgggaaaggacatgctctcaaaaaactcgcagctcattatggcgtagaccgctcacatatttatgcgatcggtgacagccccaacgatctatccatgtttgaggaagcaggccaccgcattgctatggggaatgcagtcgatgtcattaaagaaaagagcacttatatgacaaaaggcaatcatgaagacggtgttgcttactttattgatttgcttttacaaaatcaattccacgaaaaaaagacgcttgtctgatcagcgcctagagagaagtctaaaagtccgatacgagcattgatcgggctttttctttattttttaattcgaactgccgtctcatacttatccttccagtacgtacttgttttcatattcgtaagcacgacaccatttgagacggtcacatgaatgacttgatttgaccctgcataaatcgccggcatcaatgacgttccactaaagaaaacgagatctcccggcttcagctccgaccgcttcacaggggtacctgccttgacttgacctgacgcatagcgaggcagctccataccaagcacttcacgatacacatactgtgtgaaccctgctgtgtcaaagccttgctttggattcatcccacctttaacataaggaacttcaccaatatacgtagcagcttttgagacaatcgggtcttcttttgctaatttcagctccgttaatcgtttcgcacctgtccatttttcgcgccaatacgactcagacaaataagaaatcgtcacactttccgaacggctcgcatgaataaaacggtcgcccccaatatacatccctacatgagaaatacctggcttatatgtgttgctaaaaaagacaaaatccccaggacgtatatcatctaatgccactttttctccaaccatccactgctgttcagcacttcgaggcaaataaatacctagtgatttttcaaatatatattgtaaaaagcctgaacaatcaaagccaatcttagggtctgctgcaccaaatacataaggaatacctaaatatttcatcgcatcttgcacaagacgatcatccgagatttccggtgtgccgggcagtcgtttgactgcataaaatcggttcgtccagtacttgcttttgctgacgtctgttttcactacaccttgactaagcgtgatgtggatgacctgatcgttaccagcgtacaacgctacatgtgtcgggatatcctttgtttcttcaaggctgcgaaaatatacaaggtcaccaggctgggctttatcccatgataccttttttccaatctgatactggtcaatcaccttccgcggcaaatcaaatgcgcctgatgtcttgtacacatattgcgtaaaccctgatgcgtcaaagcccgtttttggatcggttcctcctttatgataaggtgttccaatcaacttttccgcttgctgcaaagaagacactgtttgagcagatacttctgattgagccatgaacatcagccctgcgagcgcgcatccaccaatcaatatttctttccatttcatgatctttcccctcctttcttctatagtttcggcatgacacctaacattttacaccttttttcgacaaaaaagagcacgcaatgcgtgccctctatgctcgttagagttatttacttgcttccgtttttgactgtttttgttgttcaattttctgcatttcaaccgagatcttttgtttttcatgatctgtgaggctgtcactaaatttaaaagcagacataaagacaaagactaaaattaacgcaacaaacggccagcttgcttttagaattttcatttcttctctttccctccgttttcttttaagtgtttaactttatcagcgtgatctacttcaaagaaaatgtgtccgtctttttctttccaatccgcattcgtaccatttgtcagcatacggataatggattttgattcaaatgatcctgctttaaccggagcaggtgttgcttctttgatgtacattgggacaacttcaaatgtcgcttttccatcttcattcagatgatactgaacaagtgcagaatcacgtgttcttgaccagccttggtcaaaaataaagtttcctaagctatagaagatcgccgtgccgttatagacttccattggctcaagaacgtgcggatgagcaccgataatgacatcagcaccagcctttgacatcgctcttgccaattctctttgtctatcgtttacctcattgttgtactcctgtccccagtgagcatgaacaacgacgatatctgccttttcagcagcctgcgaaatcatcggaataaagatagatggatcggctggcaagatacctgcctggcgattcgttgctttaaaatctttcccatacacatcagtaaaaccaagtgtagcgattttgacaccatttacttctttatacgaaatgttctgcttcgcatcctgaaggttacggcctgcgcctgtataatccatgccagcttgatcaaaggcatcaatcgttttgtttagccctttttcaccatagtctgccgcatggttattcgcaaagtttaatacagagaaattcaaatctttcaacgctttgacagaatcctcatctgtttttaaatgaatattcttttgcgccgcttgttcttgatctgatgcgactggatgctcaaagttaccagtcacataatctgacacatcaaagtatggtttggcataccggaagagatgctgttttccataacggtctgttactttctctacgtttcttccaaacataatgtcaccgacaaacgaagcggtcaggatgttttctgggttcttttgtacagttggcacttttgcttgcccgataaacgtaaatagaaatgtacaagcaatgacgatcggtaaagcaatcagcacgtgtttattcgtttttttcttttggctctttgtgattttcagcagcttttcctgaaagctcaattttttattcatcattggacacaccttatcttaaaatagatagtaaacatacatgatggcaaatgttgcaccacttagaagtaacgtgcttccaagggtaattgtaagaccttgcttttgaatcgtatttgcaatcaatccaggaacgataataccgattccgcggaattctgctatttcaaatggaaccactggatagaagaaatcaaagaccagctttaaggcaatccctgtaatcagcatcgcagcaaactttctgcgtccgtataaaatcataaatttcgaaagaccaaagcgaacgatgacatacgtaagcaaactgacagataagacaactaaaatgaaaactggctggttaaatacaagcgctagataacctggtacaacaagtccagctggtacgattcctgttttttctgcaaagattaaactaagtagaacacctaaaattaacgagatataaagatctgatccgaacattttctatatttcctcctagctgacaagctgcttaattttgtattcttgaattttttcgattaacggttcagcggcaccatgaatattgccgactccataaaccactcgattatgaagctttttctcaagcatgttcataatttcttctgtagattgatattcaaggttgtgtaagtggtcagccggaatttttccatcctcatatgcttttacaattggatctgttgtttcaccaattaagacgagatcacttgcttcaatataaggaagtacatcttccgcaaactggatcgttcgatctacacgatccgcacggcagttcatgataataatcggttcatctgttggatatccaatttctttcacacgcttccaaatgttcaatgtagatgatgcgtcatttgccgcaaaaccatttacaaagtgtccaggcgttttcgcatccattaatggaagaattctcatcgctcctggatcaggcggcgcatttaacattcctcggaatgccgtatcttcatcaattcccaatgcctgtgcaacaccaagtgcaagtgaggcattatctgggaagaccatgtactcaaatttccgtaaatactcatcagaaatcttggaattatctgcaacaatgacttctgtattgcgttttttcgcaatctctttaaagaaatccgtatattcactatccgtaataaccaagtgtccattgtaaggaattgtcgctgtaaaggcttctgctatttcatcaagtgtcggccccatgacgtccatatgatcttcaagaacgtttacgatcacgccaatattcgcttgaagcagctcttcttgaaagattatttggtaatctggatttaccgccatacattcactgacgatggcatttgctcctctttcaacggtttctctcataacttccttctgctcaccgatattcggtccttgcggtttccttttaatcggtttctcctctggcgtatcccaataaatcattcttgcatctgttcccgttgttttgccgacagttttataacctgcctccattaagataccggttgtcaatcttgtaacggtagactttccgcgaataccattaatattgacgcgcaccggtagggcatcgatatttttctggtgacgcttcttttcaataaagccaatccctaacatgatgacacaggctataacgattaaccacatcgcttatctacatctcctttttttatgagtgtgatatgtaaattcaatcatcagtatataggttcagcataaaatcacaatcggtattatgtaacataatctttcacttcctcgtatgccaatttcctctaatcagaaggtgtattgacctagctcctctttaaatgaaaaggccaaaaggcggacaaaaatcagcctgaatttcgccttcaatcaagagtaagcgttaccatcaagcatcgaaaaatcttttgtccttttctccctaaattttttgacaattattaagatgtattttgaatcaatgttttaaagcctttcaaactctataacatcagtcatatcagcactttaaatgaatagtgcgtgttttggaatgttttcgatttttgaaggaacaggttagaaagtcatcctcatcgctcagaatgctacgtgttgacctatgacaaaggtcatctctaaaaaaatcaagtcatatgcttattttcaggtcacaaaaaattgggataagatgtaaactattgatcatttcgaaatgccttctcattacgatattcgctccttatgacctaaacaatgaaacattattcatttgtttttatcaagattcatcatttcttaacatttttaatatgattttagttgaaagttgtcatcttatgtcatgctttcaactaaggtgacgaataaaataagcctgtccgctcacactatggttaaaaaactgtgagaggaggctaaagatgccaaacgccaatgagcaaacacgcttgcattttttatcaggtagcttcgaggaaaaaatccggattctgaaaaagacatttcagcaaagcggggattttgaataccgagagttaatggtgaatgaaacgaaatctgtcttgttttttgttaaaacaagggtagatgaaggtaaattaaataatttcattatcgggaacttgttaggccctcctggaaagcaggattatacaaagtctcttagcacactcgaaactggtgacttgacgctgattacagacagtatcattgcaggaagcattgcctttcttgaagaaaatgcctcacagatcaaattatttaccgttgggcagcctccgctgcgctctatttctgagccttcttcagaaagcatcatcgcgggtgctcatgatggatttgtggaaagcttagatatgaatttatatttgctgcgttctcacttaaatgatcggaagctcgccatccagtaccataaggtcggtacaaaatcagaaactaagcttgctacaatttatatttctgatattgccaatccagaaaaggtagatgaagtgaatagacggatatcttctattaaagtagacacactgctcagtcctgggtctgtcgttgaagcaattgaggatgattcattttctatttttccgcagctgattgatacagaacgtcctgacaaagtcagatctgccatccttgaaggcagaattgttgtattgatggatggcagtccgatggccattattcttcctatcacattctttagttttttccagtcgccagatgattataatagccgctggattccagctacatttatccgtgttttgcgttatctcgcctgtatcatcgcagtcatactgccatctttttatatcgccgtgattgggtttcattatgaggtggttcctgatgaactcgctattacgatgaagaactctattattgggattcccttccctcctttaatagaagccatgctgatggaaattaccattgaactcatacgggaagctggggtgcgtctgccaaaaccaattggacagaccattgggatcgtaggcggtttggtcattggagatgcggtagtaaaagctgggctcatttcgaatgttcttatcgttgtcgttgccgtgactgccgttgcttcctttgtcctcccttcatttgaaatgacatctaccatcaggatgctgcgttttccgctcatgttcatggcttcaatgtttggatttatcggcatttcatttggccttgccatcgtccttatgaatttatgccgcctagaatcattaggtgtaccgtacttatcacctgttacaccttttaactggcaggatttaaaggacaccgtcattcgactacctatgtggatgtacaaacagcgccctgtttatttaaatccgcaaaagaaaaaacaaattgaacaattgagaggatgggaaaagaaaaatgaaaaataaaatatctccatctcaagcggtcttttttctcattcaatctcaaattggtgttgggattttagggcttcctcatctgctgatgaaggatatggggcacgatgggtggatggccatcatcttagccggcgtatttattcaaatcatcaacaccatattcatttacatcattcagaaatatcctgacatatcgttcttccaagcattaaccaaagtctatgggaaatggataggacgaattttgatcgggctgtatactatatattttgcctcggtctgtattgtggttctgtcgattttcaccagaatacttggaatatgggtactgccacttacgccaaactgggtcattaatttattgctgatgatctctattatctatattgcaaaagaaaaaatcacagcgatcgtcagatttaactttatcttgactccctttttgctcatgctgtctttactcatgttctattcattaaaaggaaccaatattgactacctcatgcctttcttccagacggacctgtctcagtttcagcttggattgaaagatgtggtactctcaatgaacggctttgagatgattctcatcatctctcctttcatgaaaggcaccatcaaagaacggtataaagtcatgaccatttcaaatatatgcacgacacttttctacctatttattacattgatttgttttatgttcttcagcccgattgagctggatattattccaaatcctgtgctttatctattaaagaccgttacattcggaataattgaacgaacagatttaatttttcttagtttctgggtgtttgttattcttgccacactcagcaattacctttacttctgtgccaatggcctagcgagccttcttaagaaaaaagagcataaaaaatatgtctattattttgctatttttatttacgcggcttgctgtttcctcgcaaacgataactttagaatacagcgctttaacgactttacgaccattgctcagatctcagtaatttacacacttccgatcattatggccatcatcatctttatcaaacatcgcaaagggaaggtgaaatcacatgcgtcataagtttttgctgacgctcctcatgtgtatgtctctgatcttcatgcctggctgctgggatcaaaacttattaaaaaacatttcacttgtgctaacgtctgcggttgatcaaggtgaggacgacaatgcgaaattctccatcacctatcgtaaagtccagcagtctcaaagcatggagcaaggaaattcaggcagctatttaaccactgttctcacaacggaagctcctacattaagaaaagcaagaaccaacttcagccgaattgtcgatcaaaaaattgatatgtcaaaaatgcgggtcatgctcattggtgatgaatttgctcaaaatcagattcttccttacttagatatgttttatcgagatccaaaaagtcctttgctcgcaaatcttgcagtggtacaagggggaagctgtgtggaattaatcaatcagctcctcaaggagaagctcattgtgagcgattatttaaacaacctcatcaccactgcatctcggtcctcccaagtagcaccgaaaaacattcaaagcattcgttccaaaatgctacaaactggagaggatttcacactgccgttacttcactatgatcaagagaaaaaactaacgagtgtaaaaggcgtcgccctattcaataatgagaaaaagaaaggtgagctgtacggacaagatgccactcttctcactgtcatggacgagaaaatgggcaattatgcaaacttcactaaaaaagtaagaagtgatatgaaatcaaaggagaacaattacatcaccattcaagtgacagattcaaatagagacatcaacattgtcaatcctgaccatcgaaacttaaccttttctcttgagtatgaatttacgacctctgtccttgaatacccgaaagataatctagacacagataaaaaaattgaaatgctcaacaaaaggctttctgaaatttttacaaaagaagcagaaaaagtgttatctgttctgcaagaagctaactctgatgtactcagcctagggagaaaatatcgggtaaaacactatgatgaatatatgaaaatgaattgggtcactgattatccaaatgtaaaaatcatcccaaaagtcaaagtgaatattacccaaacagggattattagttaagaaaaggaagagtgcatctttcttttctttttttatttttttaagattgtcatttaaaagctttcatgataatctatttgtgtaaacggttacacattcacgaagggaggcactccattggctacaattaaagatgttgcaaaagctgcacaagtatctgttgccactgtttcgcgcgtactgaacgatactggatatgtccattcagatacgaaaacccgcgtgacacaagcgatgcaggagctgaactactttcccaatgaagtggctagatcccttttcaaaagagaatcccgcttaatcggtttgatcttgcctgatatcacaaatcccttctttcctcagcttgctagaggcgtagaggatgagattcatgcgcaaggttttcggttgttattcggaaacagtgatgaagatcgagaaaaggaattggcttatttacaaacctttaaacaaaatcaagtggtcggtgtcatcgctgtcacaaacgaacccgaatcagatatatacaatgatgatgaattgccggttgtgttcttagatcgaaccgttccacatgcaccttctgtatctgcagatgctgcagctggcgggaagatggccgcaatggaattaatcaggcgcggcagccggcagatcacactgctgaaaggacctgcccaccttcaaacagcgcggcagcgattcaagggtgcactcgatgtactaaccgaaaaaggcgtcgacttccatgtgatgtctaacgcttcgttttcttttcaagaagcccgtaaaagtgccaaggctctattccagctgtaccctgaaacagatggcatcattgcgagtaatgacattgtcgcaacagcggtcatacacgaagcacttcggattggaaaagccgttccagaggatgttcaaatcattgggtttgacgatattccgcaaagcgagctgctcttcccttccctatcgacaattaggcagccagcctatgagatgggaaaagaagcggcacagctgttaatcaaagcgattcagaaacagcctatagatcaaccagttatccaaatgcccgtctcttttattgaacgagagaccacaagaaaggtggattcacaatgagtcatattgttgtagtaggaagctgttctatggatttagtcgtcacttcgaacaaacgaccaaatgccggtgaaacagtattaggcgaatcatttaaaaccgtaccaggcggaaaaggcgccaatcaagcagtcgccagtgccagactcggtgctgatgtatacatggtcggccgggtcggtgatgacgcttatggtcaagatattctcagcaatctgcaaggtcaaggggttcgcacctcatatatgaaaccggttaccgaaatggaaagcggaacggctcatatcattttagcagaaggtgataacagcattgttgtggtcaaaggggcaaacaatgaggtgacacctcactatgtaacagatgctctttcttctattgaagatattggaatggtcctcattcagcaagaaattcctgaagaaacagtcgaagccgtctgcaccatttgcagcgagaaagggattccggtcatcttaaatcccgcaccagctcgtcaagtttctcagcaaatattagatcaagctgcctatattactccaaacgaacacgaagcagctcttatgtttgatggactcaccatagcagaagctttgcgccaatatccaaacaaattactcattacagaaggaaaaaatggtgttcgttactttgacggaataaaagaagtgttggtgccgggctaccctgtgaaagccgtcgacactacaggcgctggtgatacttttaacggtgctctagctgtagcactaacagagggaaaatccctatacgacgcacttgcctttgccaacttagccgcatctatctctgttacaaagtttggcgcacaaggcggcatgccaacaagagaagaactggagagaaagaaatgaaaaaaaacggcatcttaaacagtcatatcgccaaggtacttgctgaccttggtcatacagatacaatcgtcatcgcagactgcggcctgcctattccagaaggtccagtcaaaatcgacctggcattatcgatcggcacaccgtcctttcaggaggtcacctccctccttcttcaagaaatggcggttgaacatattactgtggctagtgaaatcaaagaagccaatgagcgagatcatctatttctaaagaaagcgttctcaaaatcattacatgatgtagatcacgagacgttcaaagacatgaccaaacaggcaaaagcagtcattcgcacgggtgaagccaccccatacgcaaactgcattcttcatgccggtgtcatcttttaaaaggaggagccagatatgaacattgagatgcataacatccataaggcctttggaaaaaacaccgttctttccggggtctcctttgacctcgtcacaggtgaggttcacgcgctcatgggtgaaaatggcgcaggaaaatcaacttttatgaacctgctcacaggtctttattcattagaccagggaacgattcttatcgacgggaaagaaaccgctttcaaaaatccgaaggaagcggaacaacacggtatcgcctttattcatcaagagctcaacatatggccggatatgaccgtcttggaaaacctattcatcgggaaagaaatctatacgaagtttggattgctagacacaaagaaaatgaaggttcttgcccaaagccagctggatcgattgtctgtgaacctctcgcttgatcaagaggctggcagctgttctgttggacaaaagcaaatgattgagattgcaaaggcattaatgacggatgcgaaggtcatcatcatggatgaaccaacggcagctcttacagaccgtgagattgaaaagctctttcaggtcattgaatctctcaaaaaagaaggcgtatccatcgtgtatatttcgcaccgtatggaggaaatctttgcgatctgtgatcggattacaatcatgcgcgatgggaaaacggtcgatacgaaagccatacctgaaacgaatttccatgaggtcgtcaaaaaaatggtcggccgcgaattaacagatcgataccctgagagaacgccttctctaggagatacgatccttgaggtgaagcaagcgacaagaaaaggacaatttcaagatatcagcttctccgttaaagctggagaaatcgtcggtgttgcaggcttaatgggcgctggcaggactgaaatgatgcggtcgctgtttggtcttgatcctcttgatcaaggggaaatctgggttcatggaaaaaaagctgtcattaaaaaaccaagtgatgccgttaagcttggcatcggttttattacagaggatcgcaaagatgaaggactcatgctggatgcatccattcgagaaaacattggtctgccaaacttagaaagcttctctccaaagggactgatcgataagaaaaacgaacaggattttgttgacctgctcatcaaaagattgacgattaaaacggcttcctctgaaatctctgctcgaagtctctctggtggaaatcagcaaaaagtcgtcatcgccaaatggatcggtatccagccgaaagtcttgattttagatgaaccgacaagaggtgtcgacgtcggagcgaaacgagaaatctaccagttaatgaatgaactgactgatcgaggtgttgccattttaatggtctcctctgagctcccagaaattctagggatgagcgatcgagtgcttgtcattcatgaaggaaccatcagcggagagttaaataaagcagacgcaacacaagaacgaattatgacactagctacaggagggaagtaacatgaaaccacttacttcaaatggacgatttgatcacatcatgcaaaaacttgggccattcttaggactcatcatccttgtcgccattgtttctatattaaacccggcctttttagagccattaaacatcttaaacttactgagacaaatctccattaatgccctcattgcctttggtatgacatttgttattttaaccggaggaattgatttgtcggtcggtgccattttagcactttctagtgcactgactgccggatttatcgtgtctggtatggacccgattttcgctattatcgttggctgtatcatcggcgctattcttggaatggtcaacggtcttttaatcacaaaaggaaaaatggctccttttatcgcaacacttgccacgatgacgattttcagagggttaacacttgtttatacagacggaaacccgattacaggactcggttctaactatgcatttcagttattcggacgcgggtatttcttaggcattcctgttccagcgatcacgatgcttctcacctttatcgtactttgggtgctgcttcataaaacacctttcggcagaagaacatatgccatcggcggaaatgaaaaagcagccctcatctcaggcattaaagtaccacgtgtcaaaatcatgatttattcattagctgggttcatgtctgctttagcaggtgccattttaacatccaggctaaattcagctcagccaacagctggtacatcctatgagcttgatgcgattgctgctgttgtacttggcgggacaagcctttctggcggaagaggacgaattgtcggcacactgatcggggtgcttatcatcggtgtcctgaacaacggtatgaacttacttggtgtatcatcattctatcaatctgttgtgaaagggattgtcatcttgattgcagtcctactagacagaaagaaatctgcttaaggaggcagctgctatgaaaaaatatctcattctcattctgactctctcattgttcatgctttctgcctgctcgctagaaccgccagagtgggccaaatcaacaaaagatgggaagaaaaaagacatcaaaatcggtctctcgatctcgaccttaaataacccattcttcgtttctctcaaaaacggggtgacgaaagaagcgaaaaagcttggcatcgaagtcgtcattgcagatgcacaaaatgattcagcgaaacaaacaagtgacgtagaagacctcattcagcaaggggtcgacgcattactcatcaacccagctgattcatctgctatctcaactgctgttgaatcagcgaatgcttcagatattcctgtcatcacattagaccgttcagctgaaagcggaaaagtagaagcacttgttgcctcagataacgtcaaaggcggcgaaatggcagccaactttatcatcgacaaggtcggtaaaggagcaaaagtcgctgaattagaaggtgtaccaggcgcctctgctacacgtgagcgcggaaaaggattccatcaaatagcagataaagatctaaaagtgacagccaaacaagcggctgacttcgaccgaacaaaaggattgaacgtcatggaaaacctccttcaaggaaaccctgacatcaaagccgtttttgcccacaatgatgaaatggcacttggcgctttagaagcgattcaaagctctggaaaagacattctcgtcgttggctttgacggaaacgaagatgcactcaactcgatcaaagcaggaaaactatctgccacagtcgcccagcagccagagctgatcgggaaactggcagtcggcgctgcaagcgacgtcttaaaagggaaaaaagtagaaaagaacatcgcagctccactgaaactagaacagaaaaaataaacacaaaacccccgatttctctcgggggttttcctattattccggtctttttagcacaaatgacgtccctaaatgggcgtaatcatttcccgctaaacgtgcgactggctttagttcatgagtcgaaacataacctttttccgcatcatacacagcctcatctaaatgcgcacacacaacccggccaatgatatgatcgaccgtgatctccccttcatcattttgaaaggtaagatgcttttcaagttgacattcaaagcgaatacgtgcttcctgaatgcccggcactgacacgacatggctctttacttgatgaagaccggttcgatccagctcactctcttcctgtggcagcgtagcagctgtttcgttgatatcttctattatcgtttcatcactcacatggaccacaaattctcccctgtcaatcatatgctgcgctgtgtccttcatctgaccttcgcgtcgtccgatagaaactgcgaggagcggcgggtgtccgctaatgacattaaagaaactaaatggtgcggcattgaccacatcgtctttagacagacttgtaataaacgcaatcggtcgtggaacaatagagcccgataataatttatatgcttcttttcgtgaaagctgatccatttgcaacgtaatcaattcagcacgcctccttttggtgtatcgacatcataccatacccctttttctatgcctctgattcaggctcggtgcgatgcaggatatggtggacaagatgaaataaagcaggattatgattttctcgtctataagaaatcgtccattctgccaaaagctgttcaccctcaatggaccgatacacaacatctagattaaataaacgccgggctgatttcggaatgaccgcaatgccgataccagctgtgacaagaccaatcaccatttgatattccgccgcttcctgcacaatattcggagaaaaaccgtacttttcacatagcaggacaaagtgttgataaagggacggccatgattcctgtgataaagaaataatcggttcatgacgaatatcttcgatcgtgactgcctcttttttcgccagcggatgatttttcggaatcgcaaaaatacattcactttgcttcatcaaacggctgaccagttcttcatgaggcgatgtaggatgtaaaaaaccgatatcaatctccccatttaaaagcgctcctagctgctgtggaacagaaagctgtttcagctcaatactgacagagggatacagctctctgaattcgcgtacaactggcggcagaatatcatacgtcgctgttccaacaaaccctatgatgattttccccagctctcctcttgctgtatgccgggcatgatcaacggctttattaagctgatgcagcacacctcgcacctcatgtaaaaagacctttccagcagctgttagctccaccactcgctttgaccggtgaaacaaaggaaaccccaattcttcttcaaactgtttaatttgctgactaagtggaggctgtgtcatattcaaccgtgcggctgctctgccaaaatgcagctcctccgctactgtgacaaagtattgcaaatgtctcagttccatcctttcacccctcgcacacttattcgtgaaacatattaaaaccacgttaaacatatattggaaattttccattttgaaatgtatagtaaatcatatcatgaaaatatattttcataaaaaattttacttgccgaaaggagtgcggggtaaatgaattctcaagcacaacccctaacaagacgaggagcagaattgattgttgatacgctgattgctcaaggtgtgacccatgtttttgcaattccaggtgccaaaattgacgccgtatttgatgtattaaaagacagaggtccagagcttgtcctatgcagacacgaacaaaatgccgcctttatggcagctgctgtcggccgcttaaccggcaaaccaggtgtttgtctcgtgacatcaggtcccggcgcatctaatttagcaacaggtctattaacagccaatacagaaggtgaccctgttgtcgcaatcgctggaaacgtcattcgtgcagatcggctgaaacgaacacatcaatcactcgacaatgcggcattattcaaaccagtcacaaaatacagtgttgaagtacaagacgttcataatatacccgaagccttaacaaatgcttttcgcgcggcacaaaaggggcaggctggagcagcatttatcagctttccacaagatgtcgtgacagaacacactacacaaacaccagtgtctgctcacccttctccagaactaggtcctgcaccggatgctctcatcagctcggctatcgccaaaattcaaaatgcacacttacctgttgccattgtgggaatgaaagcaagtcgtccagctgctgcaaaggctactagaacattattgaaaacacttggaattccatttgtcgaaacgtaccaaggagctggcgttctctcaagagagcttgagtctcaatatgtaggcagaatcggtttattccgaaatcagccgggcgatcttctcattgaacaagcagatgtccttttgaccatcggctttgatccaattgaatatgatccgaagcattggaatattcagccgaagcagcgacagatcatccatgttgatgacatgcaggcagatattgatcatttttatgagccggcgcttgagcttgtcggcaatatagctgaaaccgttaaacatctagcccatgacagtgttccactttctctatgcaaagaacaaattgaattcgtcactgaattgcaggagctgttaagcgacattgaaaaagcaccagaaagagaaagtcatctatctcacccgctggatgtcattcatacattaagacgcctgattcctgatgacacgaaggtcacgtgtgatatcgggtctcacgcgatttggatgtcgcgtcacttccgcgtctatgagccgaacacattccttgtgagcaacggcatgcaaacattaggcgtcgccttaccatgggccattgcggcttccatactgaacccagatgaaaagatcatttcggtctctggtgatggtggttttctcttctctgctatggagctagaaacagccgtccgcatgaaaacaaatctcgttcaccttgtttggaatgacagcacatacgacatggtggcgtttcagcaggaaatgaaatatgaccgcacatcctgcgttgaattcggacagattgacttagtgaaatatgcggaaagctttggagcgactggattacgggttaactcacctgaagagctttcaactgtcctacaaaagggtataaacatagaaggacccgttattattgatattccgattgactatcaagacaacccagacctcgccagtcaaaaatggccagaagtctttcgtgaaacacacacattgaacgtcagataagatgtccatacattacaccaaaggagtgagcggatatgggtatgatgcacccaatgaatcaacagaacgacacaagacaacatgacaaacagcaagaggtctatcaagtatcgacgatgacctctttgctggaagccgtatatgatggagatttctctctttcacaaattcccgagcacggtgatttcggcattggtacattcaatcaattagatggagagctgatcggctttgacggcgcattctaccggctgcgctcggatggaacagcgacaccggttaccgatcaagactattcacccttctgctctctagcattctttgaaactgatatcgttcatcgaattgatgcagccatgacaagcaaagagctagaagaagaaatcgaccgcattttaccgagtaagaatgtgttttatgcgatccggattgatggatcattcaaaaaggtgcaaacacgtacggtcgaaaaacaggaaaaaccttacgttccgatggtggaagcagtcaagtcacagcccatcttcgatttcgaggatattcatggaacgatcgctggtttccgtacaccgcagtacgcacatggtattgcggtgagtggatatcatcttcatttcattgacgacggtcgaagtgtcggcggacacgtttttgattacactgttgatcaagtgaccatccgaatttctcaaaaacgccatatgaacttacacttgccaaatacgcaggaattcttccaagcagacattgatcgagctgacctcgcacagcaaattgcgagtgcagaaagcagcccagatcaataaaataaagacaccccggtgattccggggtgttttttatgcaaaaggaatttttatcacttcattatatttcatttcgttagtaaattgaaattcacccattccattcgtaatgaaacatgttaaaatatcaacagaagaaaggtggttatatggtggcaaacgactttagcatcccgaacttaacattagacgaacgagataaacatattttatccctattacatgaggacgggcgtatgtcctatacagatctcggaaaacaagtcggtctttcacgtgttgctgtacaagcccgtattcagcagctaattgaagcaggtgtcattgaacgattcacagctgtcatcaaccctgctaagatcggcattcatgtttctgtcttctttaatgtagaggttgagccgaaatttttagaagcagtcgcccttcagctcgaacaggaaacagctgtcacaagcctttatcacatgacagggccaagcaagctgcatatgcatggcatttttcaaaatgagcaggaaatggagacattcctaacaaaaaaactgtacccgctggaaggcgttgtgagtgtggactgccaaatgctcattaaacggtacaaaagccgaatgggcatgaaattgtagacaggagttgaagcacttgcaatcatatatcgaactcatcatcgctatggtgcgaaccggcattctcggttttggcggaggtccttccgtcataccactcattcgccatgaagcggtagtgaaatatcaatgggtcaacgatgacgaatttggagaaacactcgccatcgccaatgcattaccaggtccgatcgcgaccaaaatgtcagcatatctcggctatcgattgaagggcgtatccggcgcaattatcgcaacagctgctcatattttaccgacatgtctcgccatggtggcactcgttacacttgtcagcgtcttaagctcctcacaaatcattcaaaatatgattggcgccgtgacgccagttattgccgtcctgcttgggatcatggcatacgagtttggacaaaaaacgctgaaaggcttcggaatgatcttcgggatcgctctgttccttcttgcctttatcgggctgcaggtgctgtccattcatccaggaatcattgtcatcatctttttatgctacggcgcttttcatttcaaactgaaacaacgctggaatcgaccaaataaagagaaaggggtgtcttcatgatgctgattctctttttattctgggcattcttcttgtccaatctattaggatatggcggaggacctgcatccattccgctgaattatgaagaaatcgtcaaccattttcattggatgacgaacgaagggttctccaatatgcttgctttagccaatgcactgccaggaccaattgcgacgaaaatcgcagcatatgtcggctatgacgtcatgggctggccaggctttattgtggcactgcttgcaactgttctgccatcagccattggattgattttactgctcaagctgattgaccgctttcgccaatctcctgtcgtcaaaggcatgaccttgtccgtccagcctgtcattgcaatgatgatgcttttattaacatgggaaattggcggagatgcagtaaaagccattggctggacgcaatcgctcgctattgccgccatctcctttttctttatgactaaattcaaaatgcaccccgcctttctcattgtggctgcctttttatatggcggattgattctgcctcattaagaaaaccgataacatggcctgtgttatcggttttcttttacatatagattggagaaatcggtctgcgcccaatcgaatgatattcgactcctgcttgttctgctgcttcaagcgtatggcagtttcgcccatcgaaaataagcggctgtctcatccattccttgtaggatgtgaggggaaacgtctgaatttctgtccactctgttaatatacaagctgcatggacatcctttatcgcttcttccatcgtatgagcaaacttgacttgatccggcagttcacgagcggcatggcgtgaggcaacaggatcatacgccacaagctctgcgcctaattgatggagttcatgagcaatgggtaccgatggcgcctccctcatatcgtctgtattcggtttaaaagcaaggccaagaagtgcaattcgctttccttcaagatttgatcccagtctctcctgaatacttcggataaaacccgctctctgctcattgtttactttgataacagcctttaacagctcaaaatcatgcgacacatgccctgcgatttggacaagtgcatttgtatcctttggaaaacaagaacctccgtagccaatccccgccttgagaaatgaagaaccgatccgctcatcgagccccattccctgcgccacccattcaacatcagcacctgttttttcacaaatggaggcaatctcattcataaagcttattttggtcgcaagaaaagcattagatgcatacttgatcatttctgcactttttcggtctgtcttaaccactggcaggtggaaatcagcatacacctcctcgagccggtctaatacagcttttgtttcagccccaatgacaagccgatctgccctcaatgtatctgaaatggcagagccttctcgtaaaaactctgggttagatgcaattgataatggctcattccgtcctaattcttgatgtatcatctgttcgatttgatcacccgttccaacaggcaccgtacttttcaccacaagaaccgcacctgatttcgcttttgtaccgatctcctttgcggcttgaaacacatattgtaaatcagcttgaccatctgcctgctgcggggtgccaaccgcaatcattaacacatcagcccgcgggtaggctacctccccatttatgtgaaattgaattcgtccttgctcaagattgcgtttcagcagttcttttaatcctggctcatacattggtggatgcccctgtttcagctgcatgacctttctccggtctatatcaatacatgccacattgtgccctgcctccgctaaacacacacctgtgaccagtcccacatatccacagcctgcaattgcaatattcatgacaccatcagctccccatacgccttatgcttgtaaagacatcgtatgctgggagctttctttccattcataaaagcatacaaaaaccccctgccatcactagcagggggtcacttttatgaaacaagaccatttcgaatatgagcaatcagattttcaagcatttcttttgttgtgacatcatttgaattctcaccaatatcatgagcgtacatcaaaatttttaaaaactcttcttgattcaaacccttattatccatgtctgtatcctttcgattccactaatttcattattatatgctgtaaggttggtttatgcaatactctaatacatcattcgacagcttttgaaatttatgaccattttcatgaaaaacttttttataaatcaccattgagctataataaaagaattggaatcttttacttggttaggagcggatcaaatgcttcagcacaacatcaatgaagaagaactcaagcaaacagccgaacaaatcaaagaacttcttcctgcaacagatgaaaacaaacaactcatcaaaaaagcattgattacttatagacaggacagtgtatatcgtctcaagcaagaatctgatacggaatggtcagcttatgtacatgatgtcgtggcagcaagagtccaccttcatgtgctgtttcctgtgagaagcagctgctcatgtccggcagatggactttgtaaacacattctcgctgtcttcttttcgctatacgctcaagtggagagtgtgaccggatttacagaaaattggtcagaaaaggatgaattacaacgcagcaaagaattaattcgccagcacttccaagtgaagcgcccagacgaacaatcactccaaagctggttgaattttttccaagaggaatttaacctctggctgaaacggataccaaagcaccagcaaacaccgcagcatttgtattacggctatttatcgatcttaaaaaaacacgcacctcattcacctgaattcaagagtttgtatgcgattcatacgtcaatcgatgtgtggttaaggatttatgaattaatcgaccttggccagcttgatgccgagaaggacttttattccatgaatccatatgtagaacagctcatgaacaccatttttgattcagtggatcacttaaaaacatacgccctttccttttccctcgatccgtttcttgaaaacacaccaactgccgttcggacacttcttcaaataaacggaccttttcaacatgaacgagtagcggtctttatggagatttggggcaccatattaaatagagggaaatgggttaaaaaagaaacagaattactaaagaacgctcagcagcaaaaacaaacggttgagcgtaccatcggattgatgcacatggattatttactgaaagaagacgatagcctttttcagcaattaaagctgctcaatgcagatatgctgccaaatgtgctcaactggctgaaggatctgacaaaccgcaaggactggaagcggctcaagctctggtatcatgagatcacctatattttagaggaatattgccagctcgacctttcctacagagaactgcgaggagctgtcagtgatttcttcttctatttagacgcatactttaagcagacgaatgatcatcatttatatgaacgctacctccagatctgcatgccctatgcgtttactgaatatagtcagctcttatatgcacaagagcgttatgcagaatggattgaaattcacagccttgttggtttctccatcagtgaactggagaaggacctgatcaaacaaattgcaaaagaggagcctgaagcgctcattccgtcgtatcaccgtgaaatctcacagcttctcgatcaaaagaatcgaagtgcttaccgggaatctgtgaaaatgctaaaaaaactgcgcacgctttatcataaaacgaaacaaactgcgatttgggaaagatatgtaaagcagctacaggattcaacgaaacggctgcgtgcgttccaagaggaaatgaagaaaggaaaattaattgatgacacgccataaacaaattgtcattcatgcagaacaaacagaagatttctctttcaccatttcagcgcaagcagaggacggacaccctgttccgcttaatgaaatgaagaggcagcttttccaatggcacgaatcgtctttttacggaacatttttagaagatgtgagctttattggcacacctgccttcctgctaagcccttggatgaccgttgaactgctagggaaaaattcatttaatacctttagtcatgtgacactaaccgatgaaacggaaccactgatgaagacagcctccaccatttatgaattcatcgaggatgaagattttattcccgattacgaggcttggacaaaaggtgtccttcgttttaaagacaaagaaggactattagatggctatacggctgagtggttctcctttgccgtacaggattacattcaatatgatgatgccttacagaacaaatggaaccgcatgacagaacaatcgcctgcgctctcatccttccaaggacattttttagatgagcaggatttcttggaaacgattggctggattgatgacgacacacctttcactgtcggcttgcgtctaaatgaaccggatttcgacggagacgattggaaaatcgaattgtttttgcgtgataagaaaaacagcgatcttcacttttttgaaggcatccgttcattgaaaagatcttggcatccttatcaagataaaatctccagagagctggagcgattcggtcaaattgtcccttggctctctttcacatctggcaccacgctcatgtcagaagacgaagcatggctcttcctatctgaagcaagtgaaacacttgtgaatatgggcattgagatcctgctcccatcgtggtggcaaattgtcaaagaaagcaccatgatgctaaaagcaaggatttcctctactccaagaggcgagtcgcatgtcggaatggatgccttgatggactttaattggcgctttgctacaaacggcatcgagctgactgaagatgagttcaacgagcttgtccaaagtaaacggcgccttgtcaatattcgtggacaatggatcaaaatcgatccaaccttcatccagcaaatgaaaaaatggatggagcgcgccgaaaatgaagggctgcacatgtctgatattttgtcacgtgaactggcagatcaagaagcatcctctgaatcggttccagagctgctagacagctcggcatttgcacatattcaatttgaactctcatctcaattaagagggcttgtccatcagttaaatgatacgcaggagctgccttcatatgaaatgagtgagtccttcaaaggcacactcagaccgtatcagcagcatggtgtcaactggctgttattcttaagatctcatgggtttggggcttgtttagcagatgatatgggtcttggaaaaacgattcaaatgattgcatatttcacatatttgaaagaacaggagcaaaatgccgctccatctctcatcattgcgccgacctctgtcttaggaaactggcagcgagagcttgaaaccttcgcgccacatttgaatgttgccttgcattatgggccatcgcgtcctcaaggggaacactttacaaaggcatacgagtcaacagatattgtcctgacatcttatggactctcacattctgatcgtgatgaattaacgtcagcaaagtgggatacgatttgtttagacgaagctcaaaacattaagaatgcccatacaaaacaatcgagagcgatcagacagctcaaagggcagcatcatattgcccttagcgggacacctatggaaaaccgtttaacagagctttggtccatttttgacttcgtcaacaaaggatatctcggcagcttgacgagctttcataagaaattcgttctgccgattgaaaaagaccgtgatgaaaaaagaattgaacagctgcagcagctgattaagcctttccttttaagacgaacaaagcaagatgaagaggtcgccctgaacctgcctgagaaactcgaagaaaaagaatacattccgctatccgctgagcaggcttctttatatgaacagctcgtgaaagatactttcgaacacatggcttcgttaacaggaatgcagcggaaagccattattttaagtatgctcggcagactcaaacagatttgcgatcacccggctctctatttaaaagagagtggaaccgatgtaaaactgctgaaacgttcattaaaaatggataaactcgcagagctgttaaaagcaatacatgagcaaggagaaagctgcctcatctttacgcagtatattggaatggggaacatgatcaagcagctggcggaaaagatgtttggaaaacccgttcaatttttaaatggcagtctgtccaaacaggagcgggataaaatggtggaccgcttccagaagaaagatttcaacatcttaattctctctttaaaagcaggaggaacaggacttaacctaaccgccgcaaaccatgtcattcactacgacagatggtggaatcctgctgtggaaaaccaagcgaccgaccgtgcttatcggatcggacaaaaacgatttgttcacgttcataagatgatcacaacgggcacgatcgaggaaaaaatcgatcaaatgctcgaaacaaaacaaacgttaaatgatcaaattatccaaagtgaaagctggattacagagctatcgacaaacgaactagaagatttattcacattaagcgccgccgctcaatcatcttaatccaagcaaaaagaggacttttctcaaacatgatgaaaagtcctcttttttcatttcatatgaacagaggttagatgttcagttttttcaatgcagatttcacgttcatatacgtattcaattcacggaagtcttctctcatttctcccattttcatcgcaagattcggtttaattcctgtcacgatgagttccgtaccagtcattaaaatcaaatcgttcagcttaaagatcgcgtctgccacaaatgaatcgacttctaataaaccagacagatcgacaataaaataatcgtccttggattgagagatataggtggagactgtggagataatcttatcaaatcttggcgctgttaacgtaccaatgatcggtaacacagaaataccatctttcacaggaacaatgggaacagaaatgttcagcacttcatcaattgattgctcaagaagctcctgctgttccttctctttcgtgacatccttttgcagaccaacgaaataaagacgtttcccttcattttcgtcaatccaaagaggagctacacttaactcattccaaaacatctgtccagattttttataattttttagctgaacagtgacagcctctttgttctcaattgctgttctaatttgttggagagcgttttgctctgtttcatttccttgaaggaaacgacaattcttccccaatacttcgggttcttgatagcctgtcatatctaaaaagcccttgttcacatatattaaaggattatcaggtaaagacgggtccgtcaccgtcaggccaacctgagtatagtctaaggcttccttgattaaatgcagattttcggacttataagattccagcgccattcgtttactctccttaatttccttacaagcgggttatgttcataattaaattatatgatgttccacatcatgtgtaaatagaagtagttctgaattcctcttttgtagaatgcgctttatcctatgtgatttatacaacgacatctgatgcatctacttcaaaaggtgtcgaatcatatacgccacaccatgttcatcatttgttaacgtgacatgatcagcgatttctttcatatcctgtctcgcattgcccatcgcaaccccaacaccagctgctagaagcatcgattcgtcatttaagctgtctcctacagccgctgtctggtctaaaggaataccaagtcgttctgccagtcttgttaatgcctggcctttagatgcatcctttgaaccaatttcaaagttatgatcggctgaactgaccattgtgacatctgaatcatcaccaaacatattccatcctttcttcaatctgtcttcaaagaaagagaaacctaaaatgttgtagaatgaaagctttcgatcctcacgaaacaactctttatatgtatcaatataagaaaaacctgactgactatattgcacttctgccgcttgttttaaaacactcaggtccgtttctggatttgcactttttaaacgatccatttcaatcgcaagaagctctctaccacgattcggtgtgaaaatggcttcgtttgtaaaaacttcataataatactcacgttcttcaagccatttcaatatgcgtttggccttttcttcttgtaaagcagctgaatgatatacttgtccagccggatcatgaatcacagctccattggcactaatcacccatgtattcatcccaagctcatcaaaaatagacctcacatcaaaatatgctcttcctgttgacacgacaacttccaatccattcgccgctgcttcctttaacgcctgctcattttcctgactcactttgtgttcactattcaataacgttccgtctaaatccgttgcgattaattgaatgtttgtcatcgttctctcctttttgtctccattttggctatcataccgctgataaaatccttcatcaagaggtgatcggtttatcattgaataaaagagtacccggccacgctacatgaccggatacacacaaggggatttaaggggacacatgacctatacaaagaaacgatggttctattacgcagtgttcttatgctcaaggcagcgtctatcagctttagctagaggggggctgtcagatgctagacgttaccttttgattcagaccgtacctcctttccttctagctgcccttagtctaccgagaaaggttgtatgtgacaaaacatgaaaatgaaagaatgccccctcaaattctctctttcctctttaatttctgctttttaccgcttgagtataaaacatcatcttgttttgtttgacgaaaaacttatttttcataaattgataaaaaacatctgaatgaatccaattactagaaggcatgtgaatataatcagatccatcccacgcaaaccaataaaaacaaagctgcccatcatgaatcgacaattgaaattcaaagtagtccatttgatcctcggtgacgtattgaaacgtgagtgactcgccttcttccatgtacacatcacaaaatgaaagaatgtctccccacgaataaacgcgcattgtgctctttgccttctcttcgccaatatgtatgtttcgtaattgataagactccataaaacatctcctttcactcatatgcagctcgctttaagcaggcagcggtttcatttatacagatgttgtatgctataatattacttacgaataatgaacgcttgtgaggtgaaaaatatgaaaacctttaggctgattgatttaaaaatcgaacttgatccaaagcaagataaaatgtccagcattccccttcgtgacggtttaatcattaataaagaagatggtgaaaatcactggatgatcgaggcactcattccaaaaaaacatagacaggtgtttgaggtgctctttcagcagcacactgaagtgaagattcttgtgacgatcacaaaagaaaacaaccgccctgttcatctatctgtccaagtcaaaaacattgttgctttagaagaaaacatttctgtgctgctcgatggtaagatgattacaaatcgttatagaacagaaacagaagaagtactaaaagacctcgtcaaagaggggctttccggagaaaaactactggatgcatttaaacaaaacacataaaaaagagcggagttagccgctctttttttattgcacatctttcgattggctttgatttttcaagagatctctaatttcagttagtaaaacttccgtttgatccggcgtttctacaacctcttcttcctctacctttttccgttttaatttattcaaataacgaataaagataaaaatggaaaacgagataatcaagaaatcaatcactgtttgaatgaagcttccatataaaatttgcgcagatccgatcttaatagatagaccgctaaaatcatgtccgccaataataatgccgacaagcggcatgattaaatcatttacaagagaagtgacaattttgccaaatgctcccccaatgatgacacctacagccaagtcaatgacatttcccttgactgcaaattctctaaattctttcagcatcttttatcaccttcatctttttttgtctaatatgacgtttttttgtcaaaaatgcaagtcctgatccgttcagactagttgtttccatataaaaagcgattcattcttgatgaaccgccaggcaaatcatgatactttaggaccgatagaaaatgtgagttctgcttcacatgccacttcgccatctactgtggctactgctttccctttggcaactggaccgcgaagacgtgtcacttcaacctctaaacgaagctgatcgccaggcttgacctgtcttttgaatcggcaactgtcaattccagcaaacaaaccgattctcccttggttctcttctttacctaaaatgatgaccccaaaaacctgagcaagcgcttctacaataagcacacctggcataactgggtatcctgggaaatgaccgttaaaaaattcttcatttactgttacatttttgattccaaccgctcttttgtcaccatcgacttctaaaatacggtcaaccaataaaaatggataacggtgtggaataatgtcttgaatttgctgagcatcaagcatgtcttgatctctccttcttttctatatcgctgatcttcatttgattcctatagaagtatattatgaatgctcgtatttttcaacgtccgctccacacatatggcaaaaaatagaatctactattgcctattgtcatcaaatataatccacactacactcattgttttttcacaaatatggtaatatatattacatcattgattgaataagagggtaaaaatgaattttatgagtgataaatccattaaaaaacttctccattcgtggtatacaatgctaaagcatcgacatttttcgaaggctgaagaaatcaaaacaactctattaaaacatcaacgtaaaatatcaaaaaaacaggaactctatttacattatcagctgatgctttttcggcatcagctctggatgaatcagacagaggacttagaaaaaatgaaacatgaactgatgcagtacaaagaccaaatgaacgatcaactgcattattattttaacttctttctcggtttatacgaatctttaaaaagtgatcaaaatgatgccattcattatcttgaaaaagcagaagaaaaactgccgctgctagacgatgagctagaagaagccgagttccattttcgtacaagtggtgtttattataacaagcgctattcgttgttatcaattcgtcatgttgaaaaagccatggatatctttgcaaagcacggggatatccatagcatttatcggtgcaaaattgtcctcgcacttaactttagtgatcaaaaaaagtatgaagaagcagaagctctttttattgagatcatcgaatacgtgaaaatcattgatgatcaagaactgctcggtatcgtttattatgacgctggctttattcagtcgagacaaaaccgtcacaagaaagcgctggaatactttaaaaaagcacttcgtctgccagcataccgaaagtccgcacactcttatgtatcgtgcctctacgaaacagtgcgttcctgttataaagaaaatttaaccgatgaaggtatgaagtatattcaaaaaggattaaaagaagccgttgcttcacaatttgatatattaagaatcaagttccaaattttatttcttctctacagccaaacgccaaaggcagatgagcagattgcaaggctcgtcacatgccttgaacgaaaagaagcttggattgatcttgaggatttgcttgccgatgtctcagatttttataaaaaaaagggcgactttgagcgagccgccttttttatcatgagaggctgatgtcagcctgctcattatcgaattgtattcactaatccaagcatctgatcacccatcgtaatcgttcttgagttcatctgataggagcgctgtgttgtcatgagatctgttaattctttagacatgtccacattcgacgtttcaagtgcaccttgctgaagctgaatcgcttggcggtttgctccatttagtgctgttaatgcaccttgataagtaccgtcaactgagaataaattatctccttcagagacaagtgctgaagagttattgacttgcacaacacctagattcacttgctgattcggttgattatctcttgaaatggctgtcagacgtccatttttatcaattgaaatatcacgaaaattcgcatttaagacgatttcatttccgttttcatcaagaatcggatggccttcgctagtgacaagctgcacttgattacgattcttgcctggctgtaagtagagagaaccgtctcttgtataacgaatattaccgccggcattgacctgcatatactgagaaggcgctccaaatgcaacatctagatcacggcctgtttctttaatagagccttgcagtgagttaatggacgcattgaccatcgtacccgtaccaagccttaacccatcaggtgtcagacgactgtttgccacctgcgcatttttttcatccacttggttgaactgttgcctgatcagctctgagaaacgggtatttttcgcacggtatcctgttgtttcactgttcgcgatgttattactgataatatcaagctgcttttgtacttcgttcattgatacagctgcattgatcatcgttctaagcatgagaatcctcctttctttttcatttcttgattaatacactctgccaatttcattcactgctttttctaagcttttatcatacgcttgaaccactttttggtttgtttcaaatgctcgataagcggttgtcatttctgtatatgatttcgtcacatccacgttcgacagctccgatacaccttgacttaacgtataggacatttgaccgttattgactgcacttggcaggggctggttatcagctgtacggtataaatcatttccttctctcgctaagtttcttgtatccatcgcaacacgtacatcaatttgtccaagattttgtccattttcactcacagttccatctgcattcactttgaaattctcactctgaaccgtgattggctgacctgtcacagaaagaagagcacgcccattgatcgtcaactgattttgtgcgttcaatgtaatcgagctacttttcgtataacgaacgccttctggggtattgaccgcataaaagagcgctgatttctgattggtctcagggttgatcggcacattattttcgactagtgcgatatccgttgtttgatctgttgtttttaaagttccttgggtaaattgaggaatcagttcctgcatatatgtccccgtattaatgccgccaatcggtgtttgctgaggaacactaaaccctttgcctgaagaagtttggaaacgtcctgactccattcggctaagcagcatttctggaaatgcccgcatggccccctcatccgctttatatcctggcgtattcgcatttgcgatattatttgaaagcatttctgtccgccgctcttgagcgatcatggcagatgttgcggtgtatagtccttttaacacgtgctcacctcattaaaattctttcacatgacctaaacacaatcttctatgaaatatatcggcatatttgcagggttctttaataaaaatcccccattctttcgaaaaagaatgagggacatcattagctgagtttacgctttggcagcttgtccatattatcaagcatgacgccagtaccaacagctacacaatccatcggattctcagcaacgaaaactggtactttcagctcttctgcaagcaattgatcaagcccgtttagaagagctccgccacctgtaatgatgacgccgcgatcaataatatcagctgataattcaggcggtgttctctcaagaacttgctttgcagcctgaacaatcgcagatacagattcacgcaatgcttcttctacttctttgcttgtgacggtaatcgttcttggtaatcctgtcaccatgtctcgtccacgaattgaaatctcttcgtgacgtgcgtctgggaataccgttgcaacttggatcttaatatcctcagccgtgcgttcaccgatcaacagcttgtactcttttttaatgtagttgagaatttccagatcaaatttgtctccagccattttaatagaagaggcggttacaatgtcacccattgagatgacagcgatatctgtcgttccgcctccaatatctacgaccatgtttccacttggctgaaaaatatccataccagcaccaatagctgctacttttggctcttcttcaagaaatacatgcttaccgccgcttttttcagcagcttctttgatcgccttctgctcaacagatgtaatgtttgtcgggcagcagatgagcatacgcggcttagagaatagccctttcacatttaatgagttaataaaatgcttgagcatcgcttcagttacttcaaaatcagcaattacgccatcttttaatggacgaatcgcaacaatattcccaggcgtacgtccaaccatacgtctcgcctcttctccaacagccaaaacttttccgctgtttttgtcaagagctaccacagatggttcatttaacacaattccttttcctttgacatgaatcagtacattggcagtaccaagatcaattccaatatccctagcaaacatctatatatatcctccttgaaaatctgtttccatagcaaataccacattctgccctaattatatattctatcataatttgcagaaaaaaagatatttctttacaaaagtctttacaaaatttgtggttagaaactaccgatatgaggaagatatatatatcatgtttatgaacaaagaactaagcttactgtttcacaggctcgccttctaaaatttcttcttttttatactttaatttagtggcttctccccctcgcaagtggcggattgatttatgataatccagtatctccttcacttcattagccagatctggattaatttctggcagtctttctgttagatccttgtgtacagtacttttagagactccaaattctttcgcaattacacgaacggttttctttgtctccacgatatactttcctatcttgattgttcgctctttgatgtaatcgtgcacaccactcgacctccctaaaatggatgtgagaagtgtgaaatgagatccgtatcaatagtgtccattttcagcggcgcttgttcgtcttaatttctcatccattaggtagtaaatgccaaacacgatccctcacctcaaacactctctttgtcaggtttgtaacagtgtattagcattgcatagggaatatgctaaaaatgaagatgggacaagggatttatcagaaaatgcaatcatttcgagtggcgaaaattttcactttacaagaatgggtcgagcacgtaaaatagaaaaggtgattttatttacctagctaaatatttaataaaggtgagcatatggatacgttaaatagagagtgtttacatcaaatacaccaaagcgccaggttgctgtctaaaaaggcgaacgaagcgcttgctgcttatgacttgtacatgtcccaatggactgtacttttttgtttggacacattcggcccgaaaacccaaaaagacatttggacatatttgaacgtcgaagccccaaccattacccgaaccgtaacccgtctagaagcaaatggctgggtgcaacgtgtacaaggaaaagataaacgtgaaaacctgatcgtcatgacagatgatgctaaggcccgatttgaagaaatcaaacgtacgatggaacaatttgaagaagaatgtctttcagatttcacccacgaagaaaaacaactcctgcatacacttttacacaaattatcaactgaataggaagtgacatacatcatgaacgaacgcatttggacaagagactttatcatgattgtcctggtgaatttatttacgttcacctctttttatgcccttttaaccttgctgcctatttacacaatggatgaactaaatggaacagaatcacagggcggtcttcttgtgacggtcttcttattgtccgccattgtgacaagaccattttctggagcgattattgagaaattcggtaaaaaacggatggcgattttctcatcaacggcatttgccttactcacttatttatacatcccaattgatcaattccaaacgcttctcttactgcgtttcgtgcagggcatcttttttagcattttgacgacagtaaccagtgccattgcagcagatatgattccaaaacataaacgcggggagggacttggctactttgtcatgtccatgaaccttgctgttgtcatcggtccatttattgcactaaatcaagtaggaaaagtaggattccattccttattccttcttttttccattatcgttaccattggtgccgcttttacgatgctcatcagacaaccagagcttgaagatggaggaagtgttgtcttccgatttactttttctcacttgtttgaaaaaggtgccttaaaaacagcggcagtcggcatcattatttccttctgttattcgccgatcatttcatttatttcagtctatgccaattcccttgacttgatgggggcaagcagttatttctttattgtgtttgcggcagcgatgcttggatcacgtccatttacaggcagactttttgaccgagtaggacctcacattgtgatctatccttcgattgctctttttgcgattggtttatggatgctgacagctacacattcagctacaatgcttctgctatcaggtggtgtcattggacttggctacggatcgctagtgccatgtttacaaacacttgccattcagcactcaccagcccaccgtacaggctatgcgacggctactttcttcactttatatgatacgggtattgctgctggctcttttgtatttggtctccttgtcagcttcacagacttttcaaatgtatatctcattgcaggtattgttgtcttgctcagtatgattgttttttattggagcgaacgaaagccccaagaagcaaaagcacagaaggtctccctatcagaataggattctattttaaacttcaacggaaacatgctaaaatataggatgtttcaaatagacgattatttgaaaaatagttggcattaagcgaaggtataggtgatgttttgaattacgaactgtttaaagtgatacacgggatggctcatcattctgagtttttagatcaggccatgattttcattacgaaaaaggccattcttgtgtatgcccttgtcttattgatttgctggtttttaggtaatcacaaatttaagaagcatgtcttcttttccggtgtaacaggcatcgcggcacttatcgtcaattttgccattacactgtttcattatgaagagcggccgtttgtggcgcataaagtcgacacactcattccgcactcagcagacgcttccttcccaagtgaccatacaacaggtgcactggctctttcacttgccattcgatctcgcaataaaaagcttggcaacatcttgctcgtctttggattactcacaggattctcccgcatctgggttggtcaccattatccattagatgtcttaggcagcctggtggtatcaattgtggtcgtctttatcatgaataaattatggaaattctttgactctccaattgatcgcatcgtcactttctatgagacaattgtagggaaaatattcagaaggaagcaaaaggatcagggttctgacctgtctaactcttaagcggcttgcgataatgtgatgaagaatcttcttccacttatcgcgccgctttttttattgactgtcctcctctgaccttgttcgaaaaataaagactgacaccgatgccgataagggaaatgataatcaacgtccaccctaactgctcaaaatgaggaccagcaatttcatccccaaacaacataccgagaacggcagacgatagaatggaaccaaggtagcggcatgtttgaaaaagcccagaggacgtgccaatcatatgctgagggcttgccttgagcatcgcagcttgcagcgcaacattgccaatcccgtaactaagtccaagcagcgctagaaccagccctttcccccataatggtgccggaataaaaaagaaggtcatcgcagacgctccagccagcatcaataccgcactggctaataccggatggcgttcatccccgcggtccacccactttcccgtcagcggagagacaatgatgctcaccccagacatgcaaagcataaaaagacccgtcatttccacacgccagcctaattcatcttggaaatagctcggcaaaccaaagaaaagacaatagaaaaagatatttaaaatgataaattgcacatacacaagtgaaagccgctgctcctgtctgaacatccgaatttgaataaatggttcatccacctgatactcccaccaaataaaagcgcctgcactcaagagacaaagaattccctgtacatattgaatgccatgacctagtgataataaaaacgaaagcagaaggacaatacaaactgtaaaaagaagcattcctggcaaatcgagcctccgtaccgtttcacctatacgtagctttctctttttctgctcctttggaaacaaagatagtccaagaaagaagctgatcaaaataaaaggcagattcactaaaaagatagccggccagccgccgattgtcatcaaaaagccgccaagtgtaggtccaagcgccgtcatcgcagaagcaaaaatggacaataccgctaatgccgatgcctgcttttcctgaatatgatcccgaatgagtccgacaccagaaggataaatggcactgctcccaattgcttgcaacaaccgaatcacaatcagcaccgcaaacgtcggggcaaatggtgcacagatggctgagactgctaccaggcccagtccgaataaaaataatgttctccggctcatcacatgatccccaatccggccgctcaccggctgcgtcaccgcactagctaaataaaaagacgaaataagccaagatacagtcgtaaaagacaaaccgaattcatgctgaatttgatgcagggccaaagaaatcattgaggaattcaacggatttaacatcgtcccaaaggcaatcgcagttaaaaagacttttcggttgtccctccacttcttcatttacagcccccctctttgtgttctggcttgctaacccttccgttattatgagattcatttcccttttttaccctgatcaattcaagttctctcttggaaaagcaagacatacattttaaaaagggcgaatgttggaaaaacacatataaaattgagaatatgaggtacaaatggtaagatgctacacatattgaaaagcctactttctccttatatggagaacggctgaaaaggaggagaagcttattattaagaaaagacggttttgggtcccagcccttttctcggttgcagtattacttctgtcttcgtgtggttcaaatgaaacaaatgggaacggagataaacgtaattctacagcgaaagggtcgccaattttggaggatggaaaatttatatttgcagcatcaggtgaatttcacccattcagttacatggatggaaatcagatgtcaggctttgatatcgatgtaggcaatgcgattagtgacaaactaggcctcgagcctatacagaagaaatataaattcgcaggcattgtcgaaggtgtgaaatcaggaaaattcgatgcggcagttgcaagtcataccatcaatgaggaacgaaaaaaacacgtccttctttctaagccctactattactctggcccgcaaattttcacaagacctggagcagacattcaacatgctgatgatttaaaagacaaagaaatcgctgtatctaaaggctcgtcctacgctgatatcgcaaaggaacatagcggacaggaaccaaaatattacgacagtgatgtcgtcgctttagaagcactagccaacggaaaacacgatgcagtcgtgacggatttcgcgacaggcgcagaagccatgaagaaaaaattaaagatcgaggctcaggaaagactcggacaaagtgagcaggcaatcgctgtttcaaaagaaaatgaacagctcattaaagagatcaacgatgcgattgacgcactaaaaaaagacggaacattaaaacaaattagcgagaaatattttaatgaagacatcacagtcaaacaaaattaaaaccaagattgtgcgccttttttaggcgcactttcttcaaatggagatgattgttttgcctaccctatcacatttttttcagacgctgattgattcaagaggtatttttttagaaggtatgctgctcaccttacagctcactgtgatcagcatcttcatcggcatgttcatcgggctcttctttgctttattgaaaatatcacgcgtggctgtcttcggttatatcgccaatgcctatatcttccttgtacgcggcacaccactgattgttcaaattttcatcctatattttggactgacagaattaaatatccccgacttctgggccgcttccattgcgctcgcctttcataatggagcgtatatagcagaaatattcagaggcgccatccaatcaattgatcaggggcaaaaagaggcaggacgctctcttggtatgggacgtttcctaacaatgaggcgcattattctcccgcaagcgatgcggcgtgccctcccccctcttggtaaccagttcattattggcttaaaagattcatcactcgccgcttttattagcgtcaatgaactatttaacgtcgccacgacccaaggttcaaacagctttgacaatatgacctatttacttgttgtagccgtctattacttaattcttgtcctgctgttaacgttcgctgtccaaacctttgagaagaaactatcagtcagtgaccattaggaggagaaacatgacagaatcaaaggaactcattcgtgttgaaaaactaaacaaacacttcggagaactgcatgttttaaaggatatcgacctcactgtttatgaaaatgatgtagtcgtcttaattggagccagcggctctggaaaaagcaccttgctccgctgtatgaactttttagaaatcaaaaatgatggagaaatcatcattgatggcagccctgttcacccaaaacgcgatcaattaaacgagatgcggcaaaaaataggcatggtgtttcagcattttaacctctttccgcataaaactgtgcttgaaaacatcatcgaggcgcctgttatggtgaaaaaaacaaaaaagactcaagctgtatcagaagccaacgtcctgttagaaaaggtcggacttgcggataaagccaacgtatatccttctaaactatcaggcggtcaaaagcagcgtgtggctattgcaagagctctcgccatgaaaccagatgtcatgttatttgacgaacctacgtctgccctcgatccagagcttgtaggcgaggtactgcaaacaatgaaaagtctcgcaaaagaaggcatgacgatggtcatcgtcacacatgaaatgggctttgcgaaagaagtcgccgatcgcgtcgtctatatgcacgaaggtcgtatcgtcgaagaaggcacaccatcaaaagtgttcgattcacctcaagaggaacgaaccaaagcctttctgagctccattttataggtcaaacgccctttatttttcgtgctcaatgcatgttttttctcatttttcacgaacttttcatccatttatattgaatataaccaaaaaccatgtaagattaacttacatgaatatgttatatatgacttttctctctataatgaagaattaagaaatcaattaattctgaatgattcagggggaatgcagcatgcaaatgggtgatacagtatttatgttcttctgcgcactactcgtgtggttaatgacaccgggtttagccttattctacggaggactcgtgagaagtaaaaacgtcttaagtacaaccatgcacagcttaacttcactagcgatcgtctctatcgtatggatcatgtttggctattccttggcttttgcaccaggaaatgcatggattggaggcttagactggattggactaaaagacgttggctttgagcctggttcctacagtgagaccattccacattcattgttcatgatgttccaaatgacctttgccgtcttaacaacagccatcatctcaggtgcctttgctgaacggattcgttactcagcggtcgtcgtgtttacactcctttgggtcacatttgtatacgcgccagtcgcacactgggtatggggcggcggttggattggcgaaatgggtgcgctcgacttcgctggaggaaacgtggttcacatttcatcaggtgtggcaggtctagtcgtagcgattgtgctcgggaagcgtaaagaagcagcaagctcttctcctcacaatttgatttatactcttcttggcggagctgtcatttggtttggatggtttggctttaacgttggaagtgcccttaccttagacagtgtcgcaatgtttgccttcattaacaccaatacagcagctgctgcgggaatcatcggctggctgttagtcgagtggatgatcaacaaaaagccgaccatgctcggcgcgatttctggagccatcgcaggtcttgtcgcaattacacctgccgcaggttttgtcacaccttttgcttctatcatcatcggattcatcggcggcatcgtgtgcttctggggagtcttctcactcaaagccaaatttggctatgacgatgcactagatgcattcggtcttcacggaattggcgggacttggggtggaattgcaacagggcttttcgcaacaacctctgtcaatgacggtggagccaatggcttattttacggagatcccagcttactttggaagcaagtcgtcgctattgtagccacctatgcctttgtagctgttgtgacatacgtgatcatcaaagtggtcaatctcttctttaagattcgcgcaaccgaagaagaagaatcagtgggtcttgatttaaccatgcatggggaaaaagcttatcaagattaaagaaaaaggggtgtctctatgagcaaaatgtataaagtggagattgtcacacgtccagccaattttgaaacattaaaggtggagcttggaaagattggtgtcacttccattaccttttcgaatgtacacggctgcggtttacaaaagggacatacagagttataccgcggcgtcaaaaaggaaagcaatgtgtacgaacgattaaagattgaaatcgtcctaagcaaagtacctgtcgaacaggtcgttgaaacagctcaaaaggtacttcgtacaggcgaaccaggggatgggaaaatttttatatatgagatagaaaatacaatcaacattcggacaggtgaagaaggacctgccgccctttaaaccatcctccgctgagtgcgggggattttttaaagacagaaaaaaacctctgcatgattcatatacagaggtttcaagacttaagattgttttgtttcttcagtttgactgctgtctttagaggaatcagaagacttttcttgatcagaggatttccccttctcatcagacttttcttcagatttttctccagcaggctctttggccttatcttcagcagcaggttccttcgttttttcatcagcttttggctgagcaggttcttttgcttcttccgtcacttcttgcgcggccttttcaatagttgaaacaggcttgtcaataaagctaagtggattaagcgctaaaccttccatacgaatttcaaaatgcacatggttgccgctttcagcaccataaagatttttaccagaagcaccgatgacatcattctgcttcacttcatcgccttctttaacactcacttgtgacaacgattgataaacagtcgataatccatcttcatgttcaatttcaacgacgtgaccgagaactggatcttttttcgcttgaaccactgttccactaagagcagctgtgacgtcaaacactttgccatctttatctgcaagatcaatacctttgctcaaggtataggtgttattatagtttacaagtgctgcttctttttctttttgatcagcatctgcttcatagaactttttcacgacagaaacattatcagaattctggactggcatggcaacattttcaattggctttccaacttcaacggcatcatcacgctgttcttgccctgtttgatttccatcagatagttggtctttcacatcttttgatacagcttgataccaaagaacggctgttaacacgaccgctgcgctgaccaagtaaattgcagggaatacccagcgcttacggaaaaattgctgaacttttgtgattttggaagtacgtttcttttcttcctctctcatttttcatcacctcagcaacattctgaacacttttcaaaaaatatatacacacgaaatcatttttctttttattttgcgcaatcgcatcaataatatgtatgatgaatgaaaaaagatggaggactttattgtgaaaactttcaaccgaatagcaacagaagatgacctcaaagcaatcgttgatatttacaattcgaccattgcttcaagagaagtaaccgccgatacagaaccagtttcagttgaagaccgccgacaatggtttttaaatcattcagagaaaagacctctctatgtgaaaacagataaggatggacatatttacggctggctcagctttgaaaccttttatggaagacctgcatacaacggaaccgttgaaatgagtatttacttaaaccaagactatcgcgggaaaggcttagggtcactttttttacaagaagccattgagctggcaccttcactaagcattcgaacgttacttgcctttattttcgggcacaacgaagccagcattcgattatttaaaaagcacggctttgagacatggggtcacctgccacgcatcgcagaaatggacggcagcaggtacgatttagacattctaggaaaagaattataaaatgagcgtctctcaaacaaagagacgcttttttatgatgcgtgtaacaactgttcaaactgtttcgcattttgaacagcttttctttggaggatgatgccatgttcatctatcagaatcgcttgcggaacgacagttaccccatacagctccatgatttgcgaagagcgcatatacacagcttgatcaggcagcaattgaaggagcaatgcatcatctccttgttcatctccattgatgaaaataaattgagtatcatcactagtaatgtgctgacgcatatcagataaaatgcttttgcatgtcatacaagtggtatttacaaataacagcatcacagctcttccactctgtaaatactcctttaaaatgaccttacctcctaaatgtgtatagcttcgaaataacggcgcagcatcaccaacatccgcttcctttaattcaatcccatcaagggatttaattttactcataaattttccgataaagcgggcaagcaaaaacacgacagccagctgagcaatgacaatgaataacacaataattagtagaatatcagtcatttcacttggtctccttctatatacgattcaaattgattcatccattttcttttgaacatcataatggttttccccaccgctataatcaaatagacagccactgcaatcagaaaacagatcatatgaaacggccatggaattgtttctacataggaatgtgcataaaacaacccaatcacaagagccagcatcgacacattacgaatcacaattccccagtgaagatgatcattttcaagcaaacctccacagccgcatgaaatgttacgatgtcctctcaataaattgaaggtgaccgctccagtatagatacataaaagtgctgtaaggccaatcgcaggtacaagagacatgttccacacgaacaataaacccgtacaaaccaattcaacagtcaaaaacaaataaaacattggcgccgtgagcgcaggaggcagcagtcgataagcattcatctgctgaatatgcgccgtttgttttctcactttatcaagccatgcacctgcaaagatcattcctaacaaatagacacctataaaataaaagacactcaccttacgccatctccttttgttgaaatagttgggattgtgcctcgtaaagccttttgtactctccatctagcgccattagctcttcatggttcccctcttcaacgaaagcaccatccttcatcacgataatccgatctgctaagcgggctgctcccatacgatgtgtgataaacaagaccccttgatcctgcgtatgatcgaatagctttcgaatgagtgcaatctccgatagtggatcgagcgcagaagtcggttcatctaaaatgataaaatcactttctctaaaaaaggttctcgccatcgcaagcttttgccattgtccgccagacagttcatgaccttcttcaaaaaaacggccaagctgcgcatcgtatgtttcttccatttgatgaattcttttctctatgcctgcttgccgtgcagctgagatcatgcgctcttccttatctatctcgtcaatacgtccaaatccaatattttctttcacagtgaattcgtacttcataaaatcttgaaaaaggacagccattctcgcatgataggattttttacaaatggttgaaatagactcaccattgaccttttgcatattcggcttgtctggatcatataaaccggtcaaacatttaattaaggtcgtcttacctgatccgttatcacccaccaatgcaatgcgttcacctttattgatatgaaaatgtatatgttcaatcgcaggcgttttcatattcggataggtaaatgagagattttctagcgtaatggactgaatacattcaatcctccgaagcgatgccccttcctctgtctgctcaccaatttcttcttctctcttttgaaaagttctcatttcatcaatatagagactcgtttcatataaactagaacattctctcgtcaaatcctgaaaaccactttgaatattttgcacagcttggagcacagcaacaaacgtacccgcagctaatttcttttgaaagataagaaagacaataaaaagaccacagcacacataggcaaatgtcataagcaatccgcctgccatctcccagcgaacctgacgtttgagtaatttatatttttcatctgcactttttacataatgacctttccacttttgcagaaggtaatctccaattccatataaacggatttccttcaatgaatctcgctgtgcaacaaggtcggatacatacatttctcttcgatcattggccgttaacattcggtttaattgataccgtgcgcctccaaagaaaagctcaatccacaagacaggcagtgtacataagatcagaataaccgccaagccccaatggataccaatcatataaatgagaagtgatacaacagtaatcaatgcgctcataattgtaaaaatacttctaaccatactcagaacatgctgatgactgttcatcacacgttgactttcattataaaaagacgggtgttcaaatgtaatatatggaagcctgatcgccttttgaagcaattcacccttcaaatgcaaaccaatcaaatttgtcgctttctgctgactaagctgaagaatgaattgaagcccataccctaaaaccacaatggtcatttgcaatccaaataaccataaaaccttttgaatgtctccagaagaagtcataaataaaataatttcattaatcaatgtttgaataatccaaacactagccaaaggcataaagccaacgatcacttggatgaatagagttaacagaagatatgatcgacttcttttccaagtataagagattgcatataaacaatggttcactgtactcatcaaacgctccaccttacaccatttagtataattgacatatttttgatatttatattatgatagctctgcgtaacttcacactgagaggacgatatacgatgacttcaatcttacttttacagttaactcttattctttgcagccttttattgacgatcggaatcatgatctatttaaaacaccaaatggcattaatcatcttaccaatccagcatgttggacaaaaacttgttcatccgctactcgaaaaaccatcacctattcaaataaatgatttactgcaaaacaatcacaagcaacagttgcttatattcactgacacagcatgtccgcactgcattccatcactggaacaattcctagaaacgaaaaagcagcgtcaattagacatttcttttagtattttgttaaagaatgggaaagaagaggatcaagaattatatcgtgataaccaaaccagcatgcgaattatctcagtagacgaacaaatgataggcgcctttcatattgaagagtttccatattacatcatggtagaagaagatgaaacaatctcatatgcagccccttttcccgatggtctttattcaaggttctctgcaaaataaacataaatgaggcatgtgaagataaaaaacacacgcctctttttttattggtttggatctgcctgaacatcctgatccttttcccttgcagcgatctcactcgcttcacttgaagctgtggcttgttcctcagcttgttcaaactcactgcgagcctcatttgaaatatctacttggtcaccatgctgattcacagtaacggacgaagaagacgattctttttgaacctctttctctagttcctttaatttagacacatgaagctctaaatcttttccttgctgaactagagtcaattgttgaaataatgcctttctctcttctggagaatggtcgccttgaacaattttcgctgcttggtttaaaaaagaattggatgtttgacccgcttgacgactgtttgacgtctgcatagcatttgttaagaatgaaattgaagatatgctcatgcgttcacatcctattaaataaaatccttgaatttagcagccacatctaatgcgttcttggctagtacaaatctcacctgtatcacgatccacgtagtaacggaaagttccaacaccttgaaggaaacaagttggcgctgatttgcatgaagtgactaatttttgcaaaatacatcttgaagctgcaggttgaacattggtcattttgtttaagaaacgatctaacatatgaattccaccttccaaattttatggtaatacaacacaataataaccaattaaaagacaactaacaacatattttgataattttactaattatttttaactactaatcttatttgttacataaattgtcgttaaaattcatagtaaatgttacttttttcttattcgaagataatttatttatctataaatagtaaagtgaagatagaaatattttttatttgttctacattcactcttcctaaagtactacttgctcaagtatgataaagagtgaatacataaaggagtgaacaccattgcaacaaactgagaaaatcattcaatctcttcattcgatcacaaagtggggaaaagttggtagtatatttctctatatttcaggtggcttagctattcttattggtttttggcttgttcttcctgctgcccttggcgtcttcctcattatgatgggaatccatgtacaaaaatctgtaaacgcagctgaacaattaattcaaactcctgatacttcttatgaagagttattagaacaatatgctaagatgatgaaaatgcagacgctatttgccatatcaagtattgtcgcagccattctctcattcatcgccattatcctgatgctgatattaggcggtctagcatttcttcaagaaattcctagtgacattcagcaatacgaaggtgaatacgaagaagagcttggtgacttttattaatggagggggggtatcaatgaatattcgatacccccttttgtttgatcattttgcattggtcaccctactaagcttgacattccctcttgatcattttaaaatacaaatcgtaactattacgaattaaaggaggggcctattactgatgcgcgtaaaaattaccttagcctgtactgaaacaggtgacagaaactatatcacaacaaagaataaaagaacgaatccggaccgacttgagttaaaaaaatattctcctcggttaaagaaatatacccttcatagagaaacaaaataattttttaggttttaaatcgtaatcattactttttaagagaggcggaaatgaacatgatcgttggcaaagggacagaaggaaatgaataagcgaatacccgttacagtattaagcggttttttaggagctggaaaaacaacaatattaaatcatgtactacaaaatcgtaaagggttaaaagtagctgtgattgttaatgacatgagcgaaattaatattgatgcagaactagtcaaacaaggcggtgagctctcccgatcagatgagaagctagttgaattatctaatggttgtatttgctgtacattaagagaagatttgttaattgaagtagagcgcctatgtaagactggtcatattgattatattgtcattgagtcaacaggtattagtgaaccaattccagtcgcgcaaactttctcttatattgatgaagaaatggggatagatttgacacgcttttgccggttagacacgatggtcactgttgtagatgcgaatcgtttctggaccgacttccagtcaggagaaagtctattagaccgtaaacaagccgtttccgatgatgacgaacgagaaatttccgatttactgattgatcaaattgaattttgtgacgtcctgattatcaataagtgtgatctagtatcaaactcagaattagaccgacttgagcacgtgctgacaacacttcaaccagaagcatctatcatcagaacctcaaaagggcaagtaaagcccagtgacattttaaatactggtttattcgactttgaaaagtccagtgcttctgctggctggattaaagaaatcaacgcagggcattctcagcatacgccggaaactgaagaataccaaatctcatcctttgtttatgaaagaagactccccttccatactggcaggttaaataattggttagatcagatgccagagcaaatagttcgcgctaaaggatttacatggcttgccacacatcatgatttaaccatattaatttcacaggctggaaaatctgttcagattgaaccaattgcctactggattgctgccttgcctgagcaagaaaaagcacagatattaaagcaagaaccagagcttcttgatgagtgggacgcagaatttggtgacaggcatacaaaacttgtgtttattggcgtagatttacctaaagcagatatcattcgcacacttgatcaatgcttactcacacctgaggaatttgatcaagattggaaaacgtttgaagacccctttcaatggaacatccaacattaagccaggagggttttaagtggcaaagaaatctaaaattgctaaagaaaaaaagcggcagcagcttgtattgaaatatgcagaattaagaaaagagttaaaagaacaaggtgactatgaagctttgcggaaattacctagagactcttcccctacccgcttaaaaaaccgctgtgaattaaccggtcgccctagaggttacttacgaaaatttaaaatgtctagaattgcttttcgtgagcttgcctataagggccacattccaggagtgaaaaaatcaagctggtaaagattgagttgatcttatcacagctccaataaaagtaaagcagtaaaaaatgttgaaaaatctattttctaagcttatctccacttttttgagacacaaaataacattttaaaaaccagcagaaaatctgctggcttttggtcatgacaggattcttcagatgaatagacctatttccaaaaacagatttccaacaatgattaggatattttctctacttttcaaaaaatcatgatcatgatactttgttgtcactacccaccgatgtatgacatttcaacttttttctgatctttcttcttctctctctcggctgaatattgatcatgtctattcgaccatatttccttcaatatgttctttatatcttcattatcttttgtcgagcgaatcacccgtttcagatcaaaacccgatgatgcaaaaagacatgtaaacaattcaccgcgagcagaaagtctcgctctattacatgttccacaaaaagcatctgaaacagaagaaataatgcctatctctcctgatccatcttggtaaaagaatcggttggctacttcacctggatattggggaggttctggtttgatgggaaatgttgaatcaattagaccaatgatctctttctttgtcatgacatgctctagattccatttgttcgtatttccgacatccataaactcgataaatctgagaatatgtccttcttttttaaagtaagctgccattggcaaaacatcctgatcattcacacctttttgaacaaccatattgatcttaataacaagtccagctttttttgcagcctcaatcccatcaaacactttttggatagaaatattccttccgttcatttgcttaaaacggtcaggatttaatgaatccaaactaatggtgactctttgaagacctgctttctttaacttttcggcatatacaggtaaaagcgttccattggttgtcatagcaatgtcttcgattcctggaatttttgagagcttttctattaagagaggcaaatcttttcgcattaagggttcgccacccgtgatgcgtattttcaccacacctaggtcctttgcaaaaagagtagcaagctgttcaatttcttcgaaactaagcagttcttctttattcaaaaaaggataatctggtccaaaaatttcagcaggcatacagtacgtacatctaaagttacagcgatctgttactgatattcttaaatcgcgcaatggtcgatgtctcttatccaatatactgtccatactttgcctcctattctgttatacgctgatggtgagtgtatatattaaaagattctcctctgacaaatccaactgtcgtgatatttaattcttctgccatattaagcgccagctcagtaggtgctgattttgagatgacgattgacactcctagttttgctgccttcaatagaacttcagacgatatccggccgctaaacacaagaattttatctctaagcggaatctgatgaagtaaacagtatccatagattttatctaatgcattatgtcttcctatatcagttctagtgatgaatagcttttctgtatcacacagtccagcattatgcacaccaccagtatgttgaaacaattgactttcttcttgtaaacatttcattagacgcatacaggtttcagcagaaatgctgattcgatcaatggctgtttttgctgttttcacatcttggagaaaataaaagtgtctccctttcccacagcaagaaccaatcacccgctttgtaaaatctgatgattgaaatccgcttgagtgaactaattcaacataggcaaagcccatactttcatctattgtaaaccttttaatctcattttcaaatcgaatgactccttctgaagctaaaaaaccgatcaccaactctttcaaatgatctggtgaacaaacaagtgttacaaattcctctccattcacgatcacagttaaaggaaattcttctacaacttcatctgttttgcaagtaaattgaccttcacggtattggtgtatgactcgtttctttttaacagaaggattcattgtatgatcttcctttcagcacaaatttagttatatgaaccaatcaaattgtgatattattttaaaaagtcataaaaatgtaacatatttctatcttatcaaactttttgattgctttatatggggggaacaaaatgaacaaatcgaaaaatcgctggctcatcgcaacaagtgctgtggggattcatttatctattgggtctgtttatgcttggagtgtttttacgaatcctttacatcaagcctttcagtggtcattgacagaaataagcctaaccttcagtattgctattttatttttaggattatctgctgctttcatgggacatttcgttgaaaggtatggtccaagggcatcagggctcttctcagccattttcttcggtatcggaatgacagggtcaggattcgctgtccacatgtcctcactccctctcctctatttattttatggtgtactcgctgggataggattaggggtaggttatattgcacctgtatcaactttagtgaaatggtttccggaccgaagaggacttgcaactggcttagctattatgggttttggatttgcgtctcttatttgcagtccaattatccaatatctcattgaaaaagtagatatcgcaaataccttttacattcttggaatttcctattttatgatcatggtgatttcatctctttatttatcaccaccaacacctgatgacgtcaaacaatttgacgtgttaaaaacaaatcaaagaaaaatccctcaggatttatcacagcttacagcaaatgaagcgatcaaaacacgacgtttttattatttgtggctcatgctctttattaatatcacatgcggaattgccattatttcagtagcatcgcctcttgctcaagaaagtgttggattcactgcaggtgctgcagctacccttgttggcattttaggtgcttttaatggtttaggacggattggctgggcttccttctcagattatatcggaaggccgaatacgtatacaattttctttagtatccagctcattgcttttcctttacttccctacttaaaagaaccactcgtcttttcaatcgtgatggcgatcatttatacgtgctatggaggagggtttgcctcaattccagcctatattggggatttatttggcacgaaacaacttggtgccatacacggttatattctgacagcttgggcagctgctggtttagcaggacctttattttcatcctttatccgggatataacaggtaactacacgcagagtctgatggtgttctctggcttatttttcatcgcttttatcatatctcttctcatccggaaggatattcagcagcttagagaaacaaaccttactgctacttcttctatctcatcccgaccttaatttgaatttgacagaatcacaatctaaaggtaatttttagatatgaaaacgctttatatagtaataggagggtgatgatatcatggggaaaacaaaacataaggggcctattaagcttaataaaaaaccctcaccaaagctatgggcttcttttgcgcctatgggacttggaaaagtaaagccgaaacacattcgagatacgatgaaagtggcgtgggagaacaaggataatctcccctatgcatatcgtattttaacgcaaggcgtgtgtgacggctgcgcccttggtgtctcagggttatatgaccaaacgctcgcaggacctcatatatgcaccacaagactaaatgtacttcgacttaatacaatgccagctattgatccaaaatggtttgaagacattcaacagctcaaacacatggacagcaccactcttcgcaaacttggtcgtatcccttatccactcattcgaaaaaaaggtgacaatgcctttacgcgtatttcttgggatgatgcattagatcaaatcgcagctaaaatcaaatcaattgataaacggcagctcgctttctatttaacagctagaggaattacaaatgaagtctattataccgctgcgaaggcagctcgctttatcgggacaaatcatattgataatgcgtctcgcatttgtcattcaccgagcaaaaccgctcttaagcggtcccttgggataggagcctccagctgtaattacaacgattggatcggaacagatgtcttaattttttggggatctgtcgctgcaaacaatcagcccgtttcaactaaatatatgtatgcggcgaaaaagaaaggaaccaaaattattgtcatcaatccgtacaaagagcctgccatggaaaagtactgggttccctctattccagaaagtgctttattcggcacaaaaatcgcggatgatttctatcaagtcaatataggcggcgatattgcgtttatgaacggtgtcatcaaacattggtttgacatggagcagcacgccccccattccgctcttgatcatgaatttattcaagctcatactaccggcatacaggatttacagcagcatgtcgcacaattgaaatgggaagacctagagacatcatcaggcttatcaaaagaaagaatgaaggaatttgccatccttcttgccaatgccaattcaggcgttttcatttggagcatgggtcttactcagcaccgctttgcaactgataatatatcacaggttgccaaccttgctatgttacgtggatttattggcaggaaacattgtggtgtcatgccaattcgcgggcatagcggtgttcaaggttctggtgaaatgggtgctgacccatttgttttgccgggcagtgattttgatgaggagaatattgaaagaatcgaaaaaatttggggttttgacattccgaagtggcatggtgacactattgggcaatcatttgagaaaatggctctcccaaaagaacatccgcaaaaactcaaaatgctgtttacgagcggcgggaactttttagaaacgatgccaaatccagatgcgatcgaaaaagctttatctgagcttgaacttcgtgtccatcaagatatcattttgaatacctctacacttgtagaggcagaggagacggtaattgttctgcctgctatgacaaggtatgaacagccaggcggcggtacatccactagtacggaacgcatggtatatttcagtccagaaattgaaggtcctcggattgaggaagccagagcagaatgggatatttatattgatcttgcaaaaagagtacggccagaagatgctgagctgattcatttcgaaacggctgaagacattcgccgcgagattgcgatcgcaaatcgaaactatgatggcatccagcatttacgtcataaaggagacgtttttcaatggggaggtgcctggctatgtgaagacggagagtgtccaacaccggacggcaaaggacatcttcttcctgcccagctgcctcaataccgaaaaaccgagggtcattttcatatcacgacaagaagaggaaagcaattcaattccatgatctatagtgaaaaggatgcctttaatggtgggaagcgtcattctatcttgatgaatgaagatgatgctagagaactttatatcaaagaaggtgatccagttgttttgtttaatcaatatggatcctaccaaggagtcgctcaatttggggagttgaaacgtggcaatatcgctgtttactggcctgaagggaacgttttaattccaaaaggtgtgtatgagagctactcacagattcccgaatataatacggcggccatattagaaaaagctgaaacctttcatgcaagaaaagaccagcactacgtggagaaacgaattgatgaattagaaactactttgaattgatcttcacctaaaaaacagctggggaaaacaatccccagctcccattcatatcctactgaccaaaagtgctcgcttcactttgtagaatgtgattcaattcttcggcatttgcagccggttgatattgtccaccgcccgcttttgcaacagactttagactttttgcttctttttcattcacgtcaaagccgatgatattaacaatggtgtcaattccgccttcatgtagttcctttgctgcttgtgaagggcttcctccacaagtttctttaccatcgctgacgacatagacaatatttttcccttcagcctggtgatcttcaaaatcttgcttcgtatctgttaatgcttttgcaagtggtgtccagccggttggtttatacacattcagagcttgctgaaatgttgatgattcatatgatccaaatccataaacggcttcagagcttccacaagaaattgcttttccagcatttttattggttccttcatgaccaaacacacgaagaaggacttgtgtatcatctgataaaatacttgcgaagctttgaatagaacgtttggcgatatcgattttcttttcgccttcaactgattgtgccatgctgccgcttaaatcaagtaatatcaccacatgagctggctcctgtttttttgtcacagcatgagctggtgaagaaagaagcaggacaaggctagccaaaatagttaatacaatattgcgtttcatttataaaaacctccctttttacatttgtacagaaaaagagaaacgaaagcatacatcaatcgtttcccttttgttcagcaagttattcgtgtaattttaatgattctgctgacaggatagaacccatttctttaccagtgcttgcttggtagtaatggcccttaccagctttggctacttgctttaattgaccttcatagccatcgttaaagtctaatccaatgacattaacaacagtcgaccctttagagttatgcaattcttttgctacttttactggatctccgccacaagtttcttcgccatcagtgatgaggtacacaatatgttttgtaccattattaagctgttcatccgtttgctttgcatcttcaagagcacgagcaatcggtgtccagccatttggtccaagtccgtttaatgagttttcgaagctgtctttttcgtaaggctgtacgccataaacgcctctaatgacttcacatgattgagctttacctgaatttttgttgtttccttcagagccaaacaaactcatacgaattttagcgtcttttggaagtgactgagcaaatttaaatacctcttgtttagcgaggtcaaatttgcgttctccctctacttttcttgccatgcttccacttgcatcaagtaaaatggtgactcttacatctttgttatgttttttgactgtagatgcttttgcaaatactggtgaagagattgacatagataatgtcaatacagctaaggttacgagtgtaaatacttttttcaacatcatttttccttcctccctatgtattaaattgaaacatcttaatcgtaaaatattctgtcttggaatggtataggactcggtccctttttctctttcatcaaaatcactaaaaatctgtcagttgtctagatacattcacccaacacatcattttttctcttgttttctccttctttcgaggggctttgtatcggccatcggtgcttgtcgggacgtaaatgtttaagatttcctgaggtgcgtcttaagtcgcaaattgacacattctgttcaaacctcttgaaacacacaaaaaagatgccccattctgaggcacctttgctttattttttagccatatacgtgttaagaaaacgatcagctggttcaatttgaatccctttataataatgtttcacgatagcatccacttttttgcctgactgtgccatataatgcgcaccgtactgactcattccaacaccatggccatacccttttgtcgtgatgatgatttgctggccttggcgttcccaagtaaagtccgctgaatgaagtcctaatgactctcgaatgtctctgcctgtcagtgttttaccgtttattacggcttttgctacttgatttcctggtgtccgttctactatctgccctacctgagcctgctgagtgagcgtcacacctaatttttgctgaaattcactaactgggatggttttcttgttttgaaattttggcgatttttcgtcccatttacttgaaacactttttaaatatgggatttcatttttccaataagcttcggcattttccgttttcccgttacttgttgaaaagaatgaagcatcaattggcttctcgtcataagtcagcacttttccttgtgtgctggcaacagcttctgtaacttttttcaacttccaattgtacgccttcccccaaattttcttgagttcctgcttgtttttatacacctggaacatttgggtatcatctacaagagagccctttggtgatttgacggtcttatcgataatcatttgtctgacgatatacgttcttgcggcgagtgcctgtgccttgagtgcttccatctcaaaatcagctggcatttcagacgctacgacaccgatcacatactcttctaaggggatgttttctacctgctgatgagcagaacgataaacggggatagcgacgggtgattgcttcaatttgactgtacccttcacttcttttttaactgatggctccgctgatacatgctggtttgcctccggtttcccttgaaacgtcggcaacacaagtaaagttggaatcattaaaataatgatgcatattcctgcgattgtccatatcattggtttcatatttggctgcccccattttcattgaatctcttttatcctatggggagggacaagctaatatgacagcttctttcattcggtggacaagtcttttgatgaagataagaggctgtttatcaactgattttactgttcgtctgtatgaataaaatttaagatgattggatacactaatgataagctttaaaaataaagcaatctatgattctaaaaaaaaatcagcatgccccaatggacacactgatttctttatgattacgcgttcagatctgatacaacttgttcttgtgtcacatctgctgtttcatcgtttactctttcaatatctgcaccgattgctgcaagcttctggtggaagttcacatatccacgatcgatatgcttcaactcagtgacacgtgtatgaccttctgctactaatccagcaagtacaagtgctgctccagctcttaaatcagtcgctgacacttcagcaccttgaagttgaaccggcccgttgataatgacagagcgaccctcaattttaatatcaccattcatacggcggaattcttctgcatgcataaagcgattttcaaataccgtttctgtaatcatgcttgttccgttcgcacgaagcaatagcgccatcatctgagattgcatatccgttgggaaaccaggatgtggcattgtttttagatcaattggcttgagctcagatggtccaatgactcttaaaccttcttcttcttcaatgatctgaatacccatttcttccatttttgctacaagtgatgtcatgtgctctggcactgcgcctttcacaagaacatttccttctgtaatggctgctgccaccatgaaagtacctgcttcaattctgtcagggatgatgttgtgttttgcaccgtgaagtgtttccacaccttcgattttgattgtaccagtaccagctccgcgaactttaccgcccatggcattgatgtagtttgccaaatcaacaatttcaggttcttttgctacgttttctaaaatcgttgttccttcagctaatgctgctgccataatgatgttttcagttgcgccaacacttgggaaatccaaatagattttcgcaccttttaaacggcctttgacttcagcctcgatgaaaccatttcctacttgaattttagctcccattgcttcaaagccttttaaatgctggtcaattggtcttgaaccaatcgcacagcctccaggtaatgcaactcttgcatgacctgttcttgctaaaagtggtcccatgacgagcacagacgctcgcattttacggacatactcaaacggagcctcagtttctagtgcatgagatgcatccactgatacttcgttattttcaaaatgtacttctgctcctaaatgacgtaacacttcattgattgtatatacatcggagagcgtaggtacatcacaaattacgcttttttctgtacttgctaacaaagatgcagcgataactggtaaaacggcattttttgctccttctactttaactgtgccgtttaacttttgaccgccgcggacgatgattttttccaaggtcttcccctccgcgtcccaaattctctatattaatattcagtcgttacgattggtgtgccaaccgtaatcgtatgattttcgttcatttccgaacttctgatggcaatttgaacattcattttatcatttgaagtcataatgaactgttcccacttatctgtgtaagcggaaagcgacacaaaattagactcaacgagatactcaactggttttgcttgaaattcatttgctaacatttcagcttttttttgcaaaacaacatccatcataccatttacatgaccatcgagacaagtaaaaattacaaatttctcttgtaatatgctttttgcatgacgtacgaactgatcatatgtatgctcccaggtattcagtgggcgagcacctttttgctcatataataaatacgacttttgattggattttgtgtcggtcttcacgagtaaaattttcgataatgtatcatttttttcatctttgtaaattcctgtgactttggtgacatgttgttcttctttttcggtccactcatactgtcgtagttcgtctttgaaacgtttcactttttttgaaaattgttcggatgaaatgtttacatttgttttggcgtgaagagtccatccatctacttcaatttgctggttgttcagaccttctgctatttgggcgagcggagaagattcttccgcacggacaccttgaatcatcagaacaaaaaaaagaataaacgcaaataatggccacccttttatatactttctcacttctcattcccccttgctacaagtgttgccgcaaggaggtctatgcatacgtggaaaagtcatcaaaggccatacttttgacacttctctttacgttcccgcataaggcagtgaccaaaccttttatgttagaacatataagggatttgtctggagaaatttaagtaatcaaggaagaaattgctgactgcagatgcaatagcaatggtaatgagcatcatcagcaatcttgcctgaatgattttcccttttttaattagtgggtcaatatttacggcaagcaatgcccaccatgtaatcgcaataaaaaacaggtggatcacaatactcacgattgcttgttgtcctacgtcttccatacagttgaatcctccttttatttatttctgtaaaggaaaactccctttcattatatccgcgaaaatcggaaagatgaatcatttggaaaaaagagctacatttagagtaaatcccctcttatcctagtgccaaggagatgatatactgcgtgtggaaggagctgtacacattgaaagattcttttcctgactttgttgatttgtacggagaactggttccctcatttgatcatgaatgggaggccattgctttctactttgattatagacagacacagctagaagaattagcgcaattgtgtcattttcataacatttctttggattattctgaggagagcctgtatcagttagaaacactttactttgatgcatttaccaagcagttgtttgctgagtggaaaatgccaatagatgcattagaagcgatgatgagtgtatatatgggagaggttgtcctccttcatcattctgatgctgactgggtggtacgtccttatatggactctccgcatcaatatacgctgggtttgcgccggcacaataaaacgtggcatagtacgcagttttgcgagcacttatatcttgaaaaacaggattctcacccgtatgtgtcaatgtaccaatccctcatgtcattctaaaaaaaatccttcttatcattgtgataagaaggattttctgttttatttccctgctacatttaaacggtttaacgcccgttttaatgcgagttctgcccggcgtacatcactttcattcgggtggttcaaatgctcttcagcacgctgtttcgctgatttcgcacggtcgacatcaactttatctgatgtttcagcggcctgagcaagaatggttacttgttcagggcgaacttctacaaatccgccacttactgcaaccaattcagttgatccactatgttttaagcgaactgcaccgatttttagcggagcaaccattggaacgtggccagctaaaataccaagctcaccgctttctgctctcacactgaccatttccacatccgcttgatacactgggccgtcgggagtaacgatattgacttgaacggtcttcatgcttttaccctcctaaggaccagattaggcctctacacccatctctttggctttttcaaccacttcttcaatgcgtccaactaagcggaatgcatcttctggaaggtgatcgtatttaccagataagatttccttgaagcctttaacagtttctttcaatggcacgtaagaacctttttggccagtgaactgctctgctacgtggaagttttgagataggaagaattgaacacgacgcgctctatgtacaacaagcttatcgtcctctgataattcatccatacctaaaatggcaatgatatcttgtagttctttataacgctgcaatgtttgctgcacttcacgcgcaatggcatagtgctcttcgccaacgatctcaggtgcaagtgcacgagatgttgaagcaagaggatcaaccgctgggtaaatacccatttcagtcagcttacgctcaaggtttgtcgttgcatcaaggtgagcgaacgttgttgctggagctggatccgtatagtcatccgcaggtacatagatcgcttgaatcgatgtaaccgatcctacgtttgtagacgtgatacgctcttgcagctgacccatttctgttgcaagtgtcggctgataacctaccgctgaaggcatacgtccaagaagggctgatacttcagaacctgcttgtgtaaaacgatagatgttatcgatgaagaacaatacgtcttgacctagttcatcacggaaatgctctgccattgtcaaaccagttagggcaacacgcatacgtgcacctggtggctcgttcatttgtccgaagaccatggctgttttttcaataacaccagaatctttcatttcgtagtaaaggtcgtttccttcacgtgtacgctctccaacaccagcgaatacagaaataccgccgtgttcttgtgcgatgttgttgatcaattcttgaatcagaacggttttacctacaccggctccaccgaatagaccgatctttccgcccttgatgtaaggagcaagaagatcaacaactttaatacccgtttcaagaatttcaacttctgtagaaagttgatcaaaagaaggcgcttgtctgtggattggatctctttgagcttccacaccaagtggctcatctaagtcaatgttatctcccagtacgttgaatacacgtccaagtgttacgttaccaactggtactgaaattggttttccaaggtctacagcttccataccacgcttcacaccatctgttgaagccattgcgatggttcttactgtatcgtcacctaaatgtagtgctacttctaaagttaagtcgatatcaacttcactttcactttccgctttatgcgaaactctgatcgcattataaatctcaggcaagtgaccatcttcaaaacgaacgtctacgactggtcccatgatctgactgatgcgtcctgttttcattgcattccctcctgacaattatttctattctaaggcagctgctccgccgacaatttctgtaatctcttgtgtaatcgctgcttgacgagcacggttgtaagagagtgtcaggctgtcgatcaattcctttgcgttgtctgttgcactcttcattgctgtcattcttgcagcatgttcacttgctttactgtcaagaagcgcaccgaaaatcaaactctctgcatattgaggaaggagaacttcaagaatttcttcttcagaaggctcaaactcataagatgcggaacgtttattaggtgtcgctgcggccgaaatgtccgttagcggcaataatttcttctctgttacttcttgtgaaatggcactgacaaagtggttatagaacatgtaaagttcgtcaaacgcttcatcagagaacatttgaactgtactgcttgctaattctttaatatcagcaaacgctacttcgtctccaagccctgttacttcagaaataactggaataccgcgctttttgaagaagtcgcgtccgattttaccaatcacaatcaccgcatattcatcagctgactgatgacgagattgaatggtttggtaagcggcacgcaaaatcgagctgttaaaaggtcctgcaagtcctcgatcagatgtaatgacgagatatcctgttttcttgacaggtcttgaaagaagcattgggtgcttagcacttgttccagttgcgattgcagcaaccacttcctggattttctccatgtaaggaacaaaagacttcgcattgttttcagcacgattcagtttcgcagctgataccatttgcatcgcttttgtgatctgactcgattttttcgttgacgtgatccttgactttatatcgcgtaatgaggccaaagatttcaccaccttttttcaggaatccgtgttcatttacgtgaaaagagagaaaaagagaatctttttctctcggaaagattactaattagttgcttggtgcaaacgtacgtttaaagccttcgatggctgtattccactcttcatcagcaggcatgtttcctgtttgagagatcgtgtcaaacaatcctttatggttttcttcaatgtacatgaataactcagcttcgaaacgtttgacatcagcaaccgccacatcgtctaagtatcctcttgtgagtgcataaagaatcgctacttgtttttcaactttaagcggtttgttcaagtcttgttttaagacttcaacagttctagcaccacggtttaattttgcttgagtcgcttggtctagatcagatccaaattgagcgaatgcttcaagctcacgataagaagcaagatccagacgaagtgtacctgctacctttttcatcgctttgatttgtgcagaaccacctacacgggatacagacaatcctgcgtttactgctggacgtacgcctgagaagaagaggtcagattgtaagaagatctgtccatctgtgattgaaataacgtttgttgggatatatgcagagatatcaccagcttgcgtttctacgaaaggcaatgctgtgatagaaccgccaccctttgcgtcactaagcttcgctgcacgctctaataaacgagagtgaagatagaaaacatcaccagggaatgcctcacgacctggaggacgacgaagcaataatgaaagctcacggtaagctgccgcttgtttagaaaggtcatcatatacaacaagtacgtgcttgccgttatacatgaattcctcacccatcgttacacctgcataaggagcaaggtaaagaagtggagctggctgtgatgcagaagctgtgactacaattgtgtaatcaagcgcaccatgcttacgaagtgtttcaacaacaccacgaaccgttgattctttttgtccgatcgctacataaatacagatcatgtcttgatctttttggttaaggatcgtatcaattgcaacagatgttttacctgtttgacggtcaccaatgatcaattcacgctgtccgcgtccgattggaatcaaggcatcaattgctttaattcctgtttgaagcggctcatgtacagatttacgatccataacgcctggtgcttcactttcgattggacgagttttgcttgttaaaattggacctagtccatcaacaggctgaccaagtgggttcacaatacgtccgattaactcttcacctactggaacctccatgatacgacctgtacgttttacatcgtcaccttcgcggatatctttgtaaggtcctaaaataacgatacctacgttagactcctcaaggttttgagccatacccattacaccgttagagaactcaaccagctctcctgccataatgttgtcaaggccatgtacacgcgcgataccgtcccctacttggatgactgtaccgacatcttttacttcaatttcagattgatagttttggatttgctgctttatcagcgcgctaatctcttcagctttgatactcactaaggtttcaccccttctaactattttcgcctgcaagctgacgttcaatgcgggaaagctttccgctgacactgccgtcataaatgcggtttccgatacggattttcactccgcctattagatccttgtcaatcacattttcaacacgcagtgatgtgactccggcttttttggcaaatacttcagataaagattgaatttcagcaccgctcagcggtttcactgaatacacgatcgcatcgtctatttgtttcgtgcggtttgccagtttcacaaactcagacgtcatctcagagaaaatgttcgtgcgtcctcggtcaatcaataaatacattgtgtgcaatacatgtgtcgaaacacctttgaaagcttctgcaatcaaatgtttctttttgtctaccgtaatttttggatgaacaagaaagtcattcaactcttggtcagcctttagaacttttttgatctcattcagctctttttcagtttcgtctactgccgaagaagcaagaacgatgtcaaaaagagcagaagcgtaacgcttagagacaatagtcacgctcatcggctttcgcctgcctctttaagatactcttgaatcaatttctcttgtgcttgctcatcaagttctctttcaatcactttagatgcaataagtacagatagtgatgcaacctgctcgcgcagtgcagccacagcttgttctttttctttcacgatttcagttctagcagactctttcaagcgctctgactcttgacgtgctgcttgaatgatctcttctttttgtttctcaccaatctttttcgcattttcgatgagtgtatgtgattcttcgcgtgcttctttcaataagacacgttgttcttcaagaagcttttcagcttgaacgtgcttttgttcagcacttgaaatttcatttcctatataatcttcacgctgtttcataatccctaataaaggcttaagcgcaaatttctttaaaagtgcaagcaagatgagcatagcgatcagctggaatatcatatccccggcattgaaacttaagccacctgctcctaaaaccactggtaactgagacatttagtacggcaactcccttctttaaataatatgttaagaaacaaaacataaaggaatggcgaagtttcgaactaatctgatcttcgccattaaaattcatattagaacgcttctcacatattaaccaaagaatgccaagaatgcgataacgacagcgataattggaagtgcctcaactaaagctaccccgatgaacataagagttcttagttctctaccagcttctggctgacgagcgattccttcaactgttttagatacgattagaccgttaccaatacctgctcctagtgctcccaaaccgattgcaattgctgctgctattaaattcattaaaaagctcctcctttaaaataacgtcctttttggactctcaaatttttagtgttcgtcgctgactttatgagaaatgtacaccattgtcagcatggtgaagataaatgcttggattgttccgacaaacaaactgaatgcctgccatacaatcattggcacgatggcacctaatgtaccaacgataccaagcgcaatgttttgcgtgtagaaattggtcgctagtcctgcaagcaaaccaagaagaatctctccagcaaaaatgtttccataaagacgcaaaccaagtgttagcgtgtttgcaaattcttcaattagtttcaatggtactaaaagcggaattggtctaaagtagtctttcgtatattccttgactccttttgccttaacaccgtaataatgtgtcaagcccatgaccataatcgctagtgtcattgtgattgcagggtctgctgttggtgatttccaccacaagttgtgatcgaccgtaatcgaaaatggcagtccaagcatgtttgaaacaaatatgtacatgagtaatgtaacgcctagcgctagaaatggggctcctgttttcatgtccatcgaactacctatgatatttcgaacaaaatcaacaatccattccatgaagttctgcgcctttgtcggacgaatagacagaacacgagtagtcagcaccgctatgagaagaacgatgatactagcaatcgtaatcatgagaacattggataagttgaacgttaaccctaaaaattctgtcgtttttgaactgtgacccaaagagtattcacctctcttccatagtagaacgtttaagttgaatgaaggaatctatcataatgacaggatatattgtcattaatcctataacaacacctgccagatgaacttcattagggtaacgccaagcaatcgctactgcgagaattgcgttggcccacctggctgtacttcccattgaacgaatggattttccttttttaaccgctcgatcaaaagcgtgcattctccgtataagaaggaataaattaaagaaagcaaaaattgtgccgataatcaaaccaagaaacagtggtttaaaaccaggcatggcatagccaaacacaaaaattgccaatagatagaacatgtatttactctgtctgcggaaaatcgcgtttggatcgttcattcatctgactcccgatgaaaaatattgtaaaaaaggtgataaatggtgatgaaaactgcgtagaagacgcttatgataagcagtcctgttcgaaaaaaatcaatcacccatcggtctaattgcacaatcagacttgaaatctaaagatctatgggatgttgcttcattcgctgatacaaaccctgataattaaagggttcacaatgaggattagtagagtgctataggctatgaaaaccttaccataataccctcgtttagcatacaatagcgtctatgatgtgtcaatccgttgaaagttaaaaaacttttctataatgatagagcacacaaaatgttcacaatttcatcaaactttaggagacacgtgacattcattgaaaaaaacagctaatgttcagtatacattgatttttctaagaacgatatcaatcgtttgtcatatatttcaaaaagcccacatgcatgtttgcatgtgggcttttattaaaacatgttatttcgttccatacatacggtcaccggcatcaccaagacctggaataatgtaacctttttcgtttaatttctcatctaatgctgcaatgtagatatcaacgtcaggatgatgcttttgcatttcttctacaccttcaggagcagcaatcagacacatgaagcgaatgtttttcgccccgcgttttttcaagctgttcaatgcttcgactgctgaacctccagttgcaagcattggatctactacgataaattcacgctcttccacatcagatggaagcttcacataatattcaacaggctttaatgttttcggatcacggtataaaccgacatgtcccactttagcagctggaatgagttttaaaatcccgtccaccattccaagaccagctcttaaaattggcacaacaccgagtttcttccctgagatcacgtttgatttcgctacttgtacaggtgtttctacatctacctcttcaagcggtaagtctcttgtgatttcaaatgccattaatgttgcgacttcatccactagctctctaaattcttttgttcctgtatgaacgtcacgaatatatgtaagtttgtgttgaataagcgggtgatcaaatacataaacctttgccatagcttgctacaactccttttctgtcatcttccggtgaactttgcacacttcctacaattctacataaaaagacatcatctttcaatatgattcgcaaatcctacaaaaaaaacccacatgccaaaaataggcaaatgggtctgctttttaataatctaattcgttatatagagggaagcgggcagttagatcagatacacgctttttcgcttcttctaatttcgcttcatcttcatgatgtttgagagcaagcgcaataatggaaccgacttctttcattgcttcttgatcgaagccgcggcttgtcactgctgctgtaccaacacgtacaccacttgtgacaaaaggtttttctggatcataaggaatcgcatttttgttcactgtaataccaatttcatcaagaacattttctgcaattttccctgtgataccaagagaacgtaagtcgataagaacaagatggttatccgttccaccagacacaagctgaatatcttcagataaaagggtttcagctagctgctttgcattgccaatgacgttttgtgcatatgttttaaaatctccgttcaatacttcaccgaaagaaacagcttttgcagagatgacatgcatgagtggtccaccttgaataccagggaagatcgatttgtcgatctttttcccaaactcttcacggcatagaatcattccgccgcgaggtccacgcaatgttttgtgagtcgtcgttgtcacaaaatctgcataaggaactggatttggatgaagacctactgcaacaagacctgcaatgtgagccatgtcgaccataaagtaagcaccgacttcatccgcaatctcacggaactttttgaaatcaatttgacgtgggtatgcacttgcacccgcaacaattagctttggcttatgttcacgtgctttttcaagtacatcttgatagtcgatatgctgcgtttctttatcaacaccatattctacaaagttgtactgtacaccactaaagttaacagggcttccgtgtgttaaatgcccgccatgtgacaagttcatacctagcactgtatcgccatgctcaagaatggtaaagtatacggccatattcgcttgagcacctgagtgaggctgtacgttcacatactcagcaccaaagatttcttttgcgcggtcacgtgcgatatcttctacaacgtctacatgttcacagccgccatagtagcgtttaccagggtaaccttctgcatatttgtttgttaatacagagccttgtgcttccatgactgcttcgcttacaaagttttctgatgcaattaattcaattttgtcctgctggcgtttccgctctagttgaattgccttgaatacttgtgcgtcttgctcaggtaaatgtttcatcagcgaaatcctctccaatctatttccattcgatgttttcaccatctcattgtacacggtttttgagtgaaatgtaaaagtttttttgggaaatcgacttctttttttacgaaaaaccgaatattcaagtggtgaagcgccttcatcattcaacattatattagaaatatatctaagctatgatcttgtataaaccgctcgttctccgccaatcagcttcggacgcgttttcgcaaacgtcacatgtgcatgccctaattgatggcgactgaggcgaacaggtacagcgactctctttagatgcatcccaatcaatgtatcaccgatatcaattccagcatgcgcctcgatggattcaactaacacaggatgttccatatgctgatacgcatgagccgccatcgaaccacccgcctttcggacaggtactgccgccacaatctctaggttaagccggaaagccacttcttcttccacaacaagagcacgattcaaatgctcacagcactggaaagccagctcaatgccggtctctcgtcttaactgatccaattcttgataaatggacgcagctatttgctcacttcctgctgtcccaatatgctcaccagccacttctgatgtactgcagccgatcactaaaatttgcccagcacgcagttcaaccatttgatgaaactcttttaacatttcaagccaatcttgaccaatgttcatgttaagcgctccttataggtgcttttcttcgtaatcagcaatcttaccaatccgtacagcatgtcgtcctgccgtaaattctgttgtcagccaaatatgcgcaatttcacgtgctaatccaggtccaataactcgttctcccattgcaaggacgtttgtatcattatgttctctagttgctttcgcactaaatgtatcatgcgccagcgcacagcgaattccttttactttgtttgctgagatactcataccaatgcctgtcccgcaaattaaaataccgcggtccacttctccgttagccaccatgttagctacaggaaaagcataatctgggtagtctacagaacctgatccacattcacaacccatatcaatgtattcaatcttcaattcatccatcagttgtttgatttcttcacgaatattcgttccgccgtgatcggatgcaatagctactttcatcgggcaattcctcctaagggtgagttgatctgttatgccttacatttattctttatttacagttatattttaacctctgcttagtcatttgcaaacaaaagcagaaaaaccgttgatgcaacggttttacaggttgtccattatgaggatgtctgatcctttttcaatttctcagccagctgctgaagcaatgcttcaagttcatcacgtgtttcctgataaacagacaggcttcctccaaatggatcggatacatcgccttctgcccctgtcgcaaattcctttagagtgaagatcttgtcttttgcatgtgcatattgctccacaatcaactgtttatgctgcatggtcatggtgaagacgtaatcagcttctcgcagaagatcctctgttagttttgctgaagagtgattcagtggaatgcttttctcaaataatgcttcgaccgcttgaggagaagccttcccagcatctgaggcaaaaatgcccgctgatttaacagtgacctctaaacctttatcttgtgcaattgaagcaaaaagggcttgagccatcggacttctgcatgtatttcccgtacaaacaaataagattttcatctttcgccctccttttcttctattatatagcatttcattctacatgttatgtaaggagactgactagagcggaaataataatttgataccaaaggctagtaaaatgattccgccaagcgccccgctatatgaccccacccatgatcgaacctgtttaccgagtaataacccaagccatgtgaggatcatactaaaaaaaccaaacaataaaatggtcatccatacgtgagaaccgtaaattccgaggcttaagccaacggaaaaactatctaagctgacacttgttgcgaaaagaacaagaccagcgccaacaggtgcgataaatggtttatcttcttttcgaatagacgcaatgatcatttgcagaccgagcaccaaaagaagcgccccgcctatataggtagcaaggagaccgagccagcctgataggagctgacctgttagcataccaaaaagcggcataaacatatgaaatataccaatgacaagtccaatataaatgatctggcggaacctcagctgaatcattcccatgccaagtccaaccgaaaaagcatccatccccagtgcaaaagccatgatactgagcgtcagcaattcgccagctagttcgtacatgtaaatcccccttggacacgcattctcctttaacctatgtttgtccaagaagggttagaactatttgaatgaagagagagtgcgccctcctgccgctttttgcagacggttcataattgctgaaccaaccccctgctctgaaaaggcttctgaaataatgacatctacatctgtctcatcaaattgtctcaatacacgatataagtttgccgctatcgtttcaggtttttctctccatccacagctgaagacaacatctgctgcaaacaacgatttcttttcttctgttgtcagcacaccaacttttaaaccttctgcctggtatgtttgaatgtgacgttgcatctcttcatcacttccaaaaaagagatacatcttagcttcaggggcatagtgtgtgtatttcatccctggcgatacaggcgcttcgtccttttttgtcagccctgggtcaatactgaccgttcctactacctcttctaatgcttcttttgtaattccgccaggccttaggatgactggaatctcatcgacacaggagacaaccgttgactcaacgccaatacccgttgaaccaccatcgataatcccagcgattcttccatcgagatcactcgctacatggtcagcttgtgtcggagatggtttgcctgaacggttggcacttggtgcggcaatcggcagaccagccgttcggataagttcaagcgcaatcggatggtcaggcattctcacaccgaccgtggataaacctgccgtgacctgctttgataaagtgccaggcttacacgaaagaacaatggttaaagcacccggccaaaaggcttccatcaatgcctttgctttttcgctttctatttgtgcaaattcatgaagctgctcaacctccgcaatgtggacaatcaatggattatcacttggacgccctttcgcttcataaattttcatgacagcttctgtctctttcgcattagcccctagtccatacaccgtttctgtcggaaaagcgaccacttcgttttgctgcaataacaacgctgcctgttcaatttgtggatagaatgtggataaatccttttctaaatccacagaccatctttttgtatttaacatcatacaaactccttttaaaaaagataaaactgttgatatatctcaattatccttttgaaagtataaaagatgatggtcaataaaacaagcgttgtccacaatttgtggataacgcttgtttaacggtggataagtatgtgtataagttcaatatattgtgattaactggcttttttttgaagaaccacagcctgttctttcgccaagaactcttttgcatgtgcagatccccacatgctttctggaatatcctctaaggccgtgaagcccatcaatgtcaaaaaatcatacgaggaggagtggttggcaacgacataaaacgtatccacacctattttccctccgagcgtttgaacactttggaacaaagacacgatatgtccctgacctaatttatctgatatgacaagagaccgcagcaggccctcttgttcactaagctgttcaagacctaaacaccctgccagctgaccgtccgcatcttccatgacaacaaatgtcgtatgctctgcaagtgtgacgccgcctttcgcttgtcctttttcaagaaaagcattgatcgctggagcatcttcttctgtggctattcttaactgataatacatgctttcacctctttttgatctcttacttcaactctatgaggcaaaaacagatttataccttttttaggagaaaagactagagacccattcgaataaaaagaatttcacttcccccgtctcttctttctcttctttgaccacttcattcacagactcatctgtttgctgggctgtcacttcgttatcttcatcaccctctggcgatgcaatggcttctccatttgaaaaatcgataaagcagagcggcgggaataacacacaccaccaattggctccatccccttctccaagcgtaattaaaatggcttcatatttcccagcaggataaacgaaatttccatagagctttgttggaaatgaagctttttggaagctgactgatacggattgatcaatgtgctgctctttcaatttcgctttggcaatacgattgatttctggtaacttggaacgaatcacacgtcttgcttcttcaatggatgtaaggtctttgacccattccgtcatattagcattgacttcgtcacggatgcttcttttcacatcctgatctgctgaacgatcactatttgctaaaatgcgtaatcgaatggcttcatcgggtatcacaacaggctgatttgcagaagcagccgctgtctcctccttgccaaggtttgcaaaagcaccgcataataatagaaacatataaagacaaatcatcattttacttttaaacatgatgtgttccccccactttttctcttcgctacaaacattgtgtccagaaaacccatctcataaacaggaaaaatgatttttttaatagattatgagtcaaataaaaaaagccgttctattaagaacggctttggagtgaggattggtaatcggaagggtacagtcttccatcccaatctcggctgatttttaaccctgcatctgttttgatgacagtcattgctccttttttctcgatttcttttttgacttttcctttttgattaataaattgaatcaccatttcataattaaattcaattctgtcatcgctttcatctgaaggcgtaaatgtaattttcttcagcttaatttgacaatcttggtcctttgctgcttctaacacgctcgggaacatgctgtcttgtgtatattcttgatattcatgctcggttaaataagacttcagcttctccttcatatcagttaggtcatctgttcgattcactgtgtattgtgcttttttatagctttctccaaatgctgctgcttcttttttaaagctcggtttgccacaagcactcacaatcaatagtacactgacgatgaccaacaccatcgcataccttctgttcacaccattcgctccttcaaaacaaatttatgtaaaaaaatcatgatcagaatgttcattcttctatatatacgtttctcttttaccataagtttcatctttacataataaaatagtccgactttattcagccggactttccgttttgaatgtgtgcgcaaacagctcggtctttcccgttaatatccttgacgatgcggacatctgccgcgggaaatgactgcaagagaagtgcttttacatcttgcccttgcgtatgtccaatttcaaagacaacgaccgcctgctcatgaagtacatggtgaagatcacgaatgaggcgcttataaaaccacaggccatcacgtccatctgtcagtgcattgactggctcatgcttcgtaaccacctctgacaaactgtccatttcttctgccgcaatataaggcggattggaaataaacagatccactttgatgccttgatccttgataggttcgagtaagtccccttgtaaaaaatggacatctgcacctagcgcttgttgattccgctttgctacctcaagtgcttcatgtgaaatatccgttgctgtgacagatagtgtttctttttcaagagcgagcgtaatcgcaattgccccgcttccggtgccaacgtccactgctttgagcggcggatcgtgcgggaagatgtcactcatcaaattcagcgccgccaaaacgacttcttccgtttcagggcgagggatgagaacatgtttgttcacctcgaagggacggccgtaaaagaattcaatacctgttagatgttgaacaggcacgcctttcttgtgctgcgtgacaaactcgctgaataaccgatctttctcctctggcagctgatcatgaaaacgtgcaagaagttcacttctgcttaggtccagtacatgcatcaaaaggagctctgctgcgttttggtctctaccggcttctgttaacaaagaagaagcccatttaagggcttcaaagatggttcgctgattattttgcattttgaagctttcttgcttggtcttccataattaatgcatcaatgacctcgtcaagttttccttctaaaatttgatcaagcttttgaatcgttaatccgatgcggtggtctgttacacggttttgtgggaagttgtacgtacggatacgctctgaacgatcccctgttccaacagcagatttacgcgtttgatcatactcagcctgtgcttcacgctggaatttatcataaattctcgcacgtaatactttcatggctttttctttgtttttgatttgtgatttctcatcctgacaggaaacaaccacccctgttggaaggtgagttaatcgaacagcagacatggttgtgttaacactttgtccaccaggtccgctcgatgtgaaagtatctacacgaatatctttttcgtggatatcaatttcaacttcttcagcctcaggcaagacagcaactgtcgctgttgatgtatgaatccgtccgcctgattccgtttctggaacacgctgcacgcggtgtgcaccgttttcaaactttagtttagaatatgcgcctttcccgctgatcataaagataatctctttataaccgccagttccagtcacactcgcttccattacttctgttttccacccctgcatttcagcataacggctgtacatacgataaaggtttccagcaaaaagcgcggcctcttctcctcctgctgcaccacgaacctccacaataacgtttttgttgtcattcggatctttcgggatcagcaagattttcagctcgtcttctaaacgttctgtttcctctgtgagctctgaaatttcttctttgaccatgtcgcgcatctcggcatccagcttatcttccagcattgctttcgcttcgcttaactggtcgtatgccgcacgatattgtctatatacctcaacagtttcttgaatatcagattgttccttcgaatattcacgaagcttcgtagggtcgttcaccacttcagggtcacttaaatattcatttagcttttcatagcgttcttcaattgattttaaacggtctaacatggtcttcacctctgttttgtgcgtaacagtctaattatagtatagcggggtatgacagtcaaaaaaatttccaaaacaattgattttctgcaattttccgctagaaaacacgatctttggcgattaattacttgttttgtctaacgtgaaggaacagttcctccttgaagagaatggtacttataattgaaaaaagggagggcatttggtttgaatacaaatgaggttgcaaaagaaattggcgtttcttcaaaaacgattcagcgttgggtcaaacagctcaacatccctgtcgcccggaatgaacttggacattatgaatttcatgaagatattgtacagctgcttaaagaagtcaaacaccaaatgagtgagggtgtgatccttcaagacattcgactgccaatccacgcagaaaccgttcaacagttatcgcctgctgcagaaactgatgcctccacaaagcggattgaagcattagaagagcaagtgaatcagctcattcaacagcaattgcacagcactgatgtagaaaaacgactgcaagaactcgaacggaaactggctaaaaaagcagatgaaggtgtatcataccagctgctccagcaccgcagagaaattgaagatctcaacactaaacttgagcgtcttaccgaaagattaaaacaaccctctcaaatagaagaaaaaaaggaaatcacgcacactgacatcaaaaaaaagcgtgcgctctttcctctatttcattcatttcgttaagaaaggctgcctcatgaggcagccttctactatattatacggtaagcgcaataatgatcggtaatgtaatgagtgacatgatggcactgatcacaaatgcggatgcagtttctgcctcttgtttctcaaatcgtgtggcgatcatcgctgcaacagctgaacctgggaaggcaacaagtaatacagcttttgtaatttcatccgccgaaagacccataagaatggcgataagatacataagcagcggttgaacagctacttttaatagtgcaatactgaaagctggtaagctcagtttaatttttcgaatacctacagtgacaccgactgcgaataatgcaacccctgacgtcacacttccgatttcctctagcatttcatgtccaattgcaggaagtttaaatcctaaaagaacaagaatgatacttgctagcggtgcaagtgcaagcggctctgataaaccgtgcaaaattgcttttgtcgtcatttttaggaaactttcaccgtctttggcttttccttttgttttttcaccgacagttgacacaattatggcaattggatcaagcaatgcatttacaactattccggtaatagcaatcggaattgcaacttcttgagccccaaataaactgcccaagaccggaatccccataaatgcaaaggtcggttgtgctgagtttaatgagaaaacagatgaatctgttaaatcatatttaaaagcaaatttcgtaactaaaaggataatgatataaaaaccaacgattccgaaaatcaatgcaacgaaaaatggaatttgactatagaatttatcttttggtgttgacagaatgctggcgataaagtgcgctggcaaagcatactttgtaacaagtgtacttacaccttttgcagatttagcgtcatagctgccgaagttccctgcgaaccaacccagcgcgataacgaaaaaaatcggtgctaggaggatcaaaatatttaaaaagtccatcttactattcctccttgaatcctttacatgtttctttatttgattgcggcattgcttagattacccgaaacaatgccgcgttacacattttattatgctcttacaatttttttatattcaggaatccacattgcatctttcacagcttgttcgatgtcgtcaggtgtttttcttgcgacaccatctttaattgctgctttagccacttcaatagccactttgatagaaacttcttgtaacttatcaatgcttggaagtagaccagcacctggtttatcatgatcaaccatttcagcaatcgcatctgcagaagcaacgaacatgccttttgtgatgatttttgattccgttacgattgagccaagaccaagtccagggaaaacgaacgcattgtttgattgtccaatttcatgttcaattccgttatactcaacattttcgaacgggcttcctgttgcaacaagtgcacggccgtctgtccatttgaatagatcttctggaactgcttccgcaagtggtgttgggttagacattggcatgatcactggacgctctgtatgagctgcgatttctttaatgatttcttcagtgaatgcgccgccttgacctgatgtaccaatcagaatcgttggcttcaccctgcgaacagcttcagcaaatgagatttgtcctttgtcatcacgtgcccagccttctacttcatcagaagaacgaaggtatggtttttggaaatcaaatacttcatcttcaaattgatctgtcagtagacctctgtagtctaatgtccagaaagcattgtttgcttcttcttcacttagaccttcaagaaccattgtgtcacgcatttgatctgcgattccgattccagctgatccagctccgaagatcatcacacggtgatctttcaattgagtaccagttttcttgacagctgcaagaacacccgctaaagtaatggcaccagtaccttggatatcatcattgaatgttaagatgttatcattgtattttttcatgatgttacgcgcgtttttgtttccaaggtcttcccagtgaagcaatgctttagggaagaatttaagcgctgcttttacataagcatcaatgaattcctcgtatttttcaccttgtacacgtttgtgatggtttccgatgtataatggatcattcaataatttttcattgtttgttccaacatctaatacgactggaatcacgcggcttggatcaatacctgcagcagccgtgtaaacagctaatttaccgattgcgatgttgataccaccgacaccccagtcaccaattccaagaatgctctcagagtcagttgctacgataagatcaatatctcctgctgttgcatgtaagttttcaaatgctttctcaatgccgtcaatgttgtcgattgaaagatagacaccatgaggtcttctgtattcatggctgtattcctgaatcgcttcaccaacagttggtgtgtacacaacaggaagcatttcgcgaagcttgtctgatataagcttatagaacaatacttcgttacggttttgcaaatcacttaagtatacgttttgacgaagacgatctggctgtgctaggaactgcttgtacgctctctccgcttgttgttctaaagtgagaacagttggaggaagtaagccttctagtccaagctcttgtctttcttcttcagagaaagcaacgcctttgttcaacgttggaatcgataatacatctttacctgtcaaagtggtttcgaggtacccttcttttgttttcttcacgttgttcatcaaaaactaccctctttctaaaatataaataaagtgaactattaatttaaagaacgattaaggagaataatccttaatcaaaaaaattatgacaagaaatcgaacttttcgtaaaaatgctttacactacagttagtcattttatgcctgcttatgctaaaacgcaagcgttgaaaattagataattttttcgtatcgttatttaatttatttaagtacaaatgatgggtgttcagccaaaatctcgaaaaacgaaacacagcggcatttgctatttttttaattgtcaagtgttgtaccaacgtcaagtcttggtacttcatggtgatgtctgcatcgtgcttcgtatgattcctgcgcacctactaaaataatgggatcatcataggaggcgggtttaccgtcgatcaagcgttgtgttctactcgctggggagccgcataccgaacaaactgcttgaagttttgttacaagctctgcacatgccattaaatgcggaacaacaccaaatggctctcctctgaagtcttgatcaaggcctgcaacaatgactcggtaacctttatcagccaattgagtgacaatgtcaatgattgtctcatcaaaaaattgcacctcatcaatgccaatgacatcggttctttctgatatgtgcgttattatgtcttttggtgaggctactgcaatcccatcgaccgatgaaccgttatgtgaaacaactgagtttgtatgatatcggttatcaatcgctggtttgaatatttttacttcttgtttggcaaaggtggcccttttggctctccgaatcaattcttccgactttccagaaaacatacttccgcagatgacttcaagccaaccgctttgtttcatcacatacataaggtcttctcccccgttttaaagttccatcaatccacgtaaaaaaacaggcaagaacggattcctgcctgtttattgtatctattattacttaagaccgtattttttgttaaagcggtcaacacgtccatcagcagaagcgaatttttgacggcctgtatagaaaggatggcactcagagcaaatctcgatgcgtacctcttcttttactgatccagtttcaaactcatttccacaagcgcatttgactgtagcttttttgtagttaggatgaattcctgttttcatctactgtcatctccttccgccctgaatccaattcggaaacagagttaatatctcagaataaattctgaaacgcacatgatgaaattataacagtgtgagtctatgattgcaaatgtattttttcaacaagctatcttcttgatgcagacatgttcgcttgtttccattcttgcgttaaaatatcgaaaaattcttggtttgtctttgtttttctcattttgcgcatgaacttctcagcaaaatcaggtgtatctgacatcgattttctcatcgcccataaacgatcaagatgctcttttggtacaagcaattcttcttttctcgtaccagaacgacgaatgtcgattgctgggaaaattcttctttctgcaagagagcggtccaaatgaagctccatgttccccgttcccttaaattcttcataaatcacatcatccatacgtgatcccgtatcaacaagcgcagtggccaaaatcgtcaagcttccgccttcttcaatgttacgcgcagcaccaaagaagcgttttggacggtggaaagccgctggatcaataccgccagaaagcgttcggccgcttggcgggatgacaaggttgtatgcacgagcaagccttgtgatgctgtccattaagatgatgacatctttcttatgttcaacaagacgcatggcacgctctaatacaagctctgctactttaatgtggttttccggtacttcgtcaaaggttgaactaacaacatcccctgcaacagaacgttcgatatctgttacttcctctggacgttcgtcaattaaaaggacaatcagctctgactccgggtgattttcagagatgctgttggcaatttctttgagcaaaatggttttcccagccttaggcggtgcaacaattaaaccacgctgcccaaacccaactggcgccatcatatccataattctagtagacaggtgattaggctgtgtttcaagaatcatttgacgatcagggaatagcggcgtgagtgcaggaaagtgaacacgttccttagctgattctgggtcgtccccatttaccgcttcgacatgaaggaggccatagtagcgttcattctcttttggaggtcgtacctttccagacaccttatctccgtttcgcaaatcaaagcgtctgatttgtgaagctgaaatataaatgtcttcagaacttggggagtagttaattggtcttaagaaaccaaatccctcagactgaattatttcaagaaccccttccataaataagagatcctcttgctcagcattcgcctttaagatggcaaaaattaattctttttttgttagtttgctgtaataagagattttgtacttttttgctaactcatacagctcttttaatttcatattttccaaagatgaaatcgaaacatctttcaatatggacaccacacttttctagtcaatgtattttcattacaaatgcatgaccattgtatttgattagcttttaattccgtttttgttggaatgacctcgctctcatggtaacgctcccactcgttttatcgtaaagataggaacaatgtgaaattgagctttgtcaacatagagaaggataatgagtatatcgtcatgatgcggcagtatttaaacttgttgaagcttaaaagaagtaaattcgcagaaaatttcgcagcactctttagttttacctcatttgcagagaatattcaactttaaaaagaaaatgatatacatttgacacctatatgaaaagcgggtaatgaatacccgctttcagattacggacgaatgacaagattcggttttttctttaagctgtgtctgccgtctacgaaacgaactgtacctgatttcgcacgcataacaacactatgtgttgttccaacagagcctttgaattgaacaccttttaatagttcaccgtctgttacaccagtcgctgcaaaaatggcgtcgtcgcctttcacgaggtcttccattcttaagactttgccaacatccagccccattttctcacagcgtctcagttcttcttcactttgaggaagaagctttccgtggatttcaccaccaagtgcctttaacgcaacagcagaaaggacaccttctggcgcgccgcctgaaccaaatagaatatcaacacctgtatgatcaaatgctgtattaatggctcctgcaacgtcaccatcatcgatcagtttgattcttgctcctgctgctctcagttcagcaatgattttctcatgtcgatctctgtttaaaatcgttgcaaccacatcttcaatatctttgttttttgcttttgctacagcacgaagattgtcaatgacaggcgcttcaatgtcgatgcagcctaccgcttctggacctactgcgatcttatccatgtacatatcaggtgcattcagcaagttgccatgatctgcaaccgcaataacagctaaggcattccagccgccgcttgccacaatgtttgttccttctaatggatcaacagctacatccacgcgaggtccgtatccattcccaagcttttccccaatataaagcattggtgcttcgtccatttccccctcgccaatgaccactgttcctttcatcggaatggtatcaaatacatcacgcattgcacttgttgcagcatcatccgcttcgtcttttagtcctcttcccatccaacgagcagattttaatgcggctgcttctgtcacccgtactagttccatcgataaacttctttccatttttgtccaaatctcctctcacagtcaaagccttatgaattttgaagttcttctatttcttggtcactcagcttttcacgccagatggttgcacccaagccttcaagcttcttctcaagcaaactatatcctctgtctatatgttcaagccctgtgatttcggtcacaccgtctgccattagccctgcaacaacgagacaagcacctgcacgcaggtcactcgctttcacctttgctccttgaagctgcgtttgtccagtgataatggcagatcttccttcgaccttcatgtttgcacccattcgacgcaattcgtcaatgtgcttaaagcgggcagagtagatcgtatctgtgaccacactcgtgcctttcgcctttgttaacagcgccgtcatcggctgctgaaggtccgtcggaaagcccggatacacaagggttttgatatcgacaggcttgagtccttcgtttctgccaacgatcagcatttgatcgttgctcgtttcaatggtgaaccccatctctctaagtttcgccgtaattgattctaaatgagttgggatcacattatcaagtacaacttcatctcccatcgcagcaccagcaattaaaaatgtgcctgcttctatacggtcagggatgatggaatgcttacagccatgaagagattctacaccttcgattcgaatcacatcagtacccgcacctttgattttggctcccatgcttgcaagcagtgtcgctacatcaataatttcgggttcttttgcggcattttcaatgaccgtttttccttcagccagtacggctgccagcatgatattgatggtcgcgcctacactgaccacgtcaaggtaaatacgggctccgactaatttttcagcgcgcaaataaatggcaccctgctcgtttgtcacctcggctccgagtgcttcaaagcctttgatatgctgatcgatcggcctaggtcctaagtggcatcctcctggcagcccaatgacagcctgcttgaatcttcctagcatagcgcccattaaataataagacgcacgcagtttcttcacttttccattaggaagcggcatactgatcatggaagcaggattgacgaccatttcacctttttcaaacgtgacctttccgccaatctcttctaacagatctcgtaatgtgtcaatatctgaaatatgcggaaggccctcaatcgttactggagaatcagcgagaatcgtggcaggaatcagtgccactgcactatttttcgcaccactaatatgtacggtcccgcgtaaggggtcaccgccggcaatgtttaacttttccatatttgtctcccttcttaaagaagatcactgttggagttatactgtttgtggatgtcgcgctttaaaaggtcttgtccaaaatttagccaatatcaagagaaagaatacaggttaaacgaaatttgtcggaagaaaaataatcgaagctttgcgaggctgtgatgttctcttctttgcacaaaacatttcttagcgtttttaaggaaaactgcggcaaacaggagacaatcccgcctgccacaatcacttatttattccagtctgctaaaaattgctcaatgcccgcatccgttaatgggtgtttcgtcagctgcttgatgactttcagcggcattgtgccgatatgagcacctctaagcgcagcttctgtcacgtgctgcggatgacgaatagatgcagcaatgatttgtgtatctaagccatgaacatcaaaaatggttttaacttcgctgatgagatcgagaccattttggccaatgtcatctaagcggccgaggaatggagaaacatacgttgcaccagctctagctgcaagcaatgcctggtttgcactaaaaatcaaagtgacgtttgttttaattccaaggtctgttaacgctttgacagctttaagaccatctgttgtcattggaattttaaccgtgatatttggtgcaatagcagcaagctcttttccttcttcaatcatttcttcagctttgagggaaatgacctctgcactgacagaacctgataccacgtcagtgatttcgcgaagacggtcgtggaatgatacgtccttttctttcgctactaaactagggtttgttgtgacgcctgctaaaatgccaagctcgtgcgcctctttgatgtctgcgatattcgctgtatctacgaaaaataacataatcgtgccactctcctatcaataaattgtctgaaatgtaaattttgattgcgctttctcaagatatggagaaaaccgcctgtgactcaggcggctttcggttctcatcaaattatccttggttagaagaaccaaattcacgcattttgccgataacagtcgctttaattgcgtcacgagctggtccaagatatttacgtggatcatactcttctgtttttgcagcaagtgtttcgcgtactgctttcgcagaagcaatttggttttcagtgtttacattgatttttgctgtaccaagtgaaattgagcgcttgatgtcagcagttgggatacctgttccgccatgaagaacaagtggaagacctgtcattttaccaatttcttccatttcagcgaaaccaaggttcggttcacctttgtatggaccatgaactgaacctaatgcaggtgcaaggcagtcaataccagtgcgttctacaagctcttggcactcttttggatcagcataaataacgccctcagcgatgacgtcatcttcttgtccgccaacagttccaagctcagcttcaacagatacaccgtggaaatgtgcaagctcaactactttcgcagttgttgctacgttctcttcgaatggatggtgagaagcgtcgatcatgacagaagtaaatcctgcatggattgcttttgcacaagattcaaagcttgaaccgtgatctaaatgaatcgcaacaggaactgttacattatattcttcgattaacgctttaaccattgcgacaactgttttgaagccgcccatgtagcgtcctgctccttcagatactcccaagataactggagatttctcttcttcagcagcttgtaaaatcgcttgcgtgaattctaaattatttaagttaaactgtccaacagcgtaacctttttcctttgcgtctttcaacatttctgtcattgaaactaaaggcatgatgaaaaatcctccctatgtagctaatttgcttactaaaaaaagctctccaccctagcatgaccagaatttctcgccatatgtaaactttcaaagtcagatcgctttcttcttcttatctaggataccaattattcgacaaatcggcaacagaatgactcgattcaatcatttccatctaaccgtttgtttcgagcggtaagtattctttgacagcatctcggatctcatcaatatcaaaaggttttgcaaagtgcgtcaaagcaccgagttctttggattcttgaatcatgtctaattcgccataggctgtcataatgatgacacggatgtcttcatcaattaatttcatgcgttttaaaatttcaattccatccattccgggaatcttcatatcaagcaacacaaggtttggtctatgatttttcacaatatctaacgcctgtagtccattggctgcttggaaggtttgatagccttctttatgaaacacttcattcaataatattctaataccatattgatcatcgacaattaatattttctcattcatctgttacaccccattgctttcatttttcgccataaaaagagctgttgttaaataattctgtttgattttcacatttcctttatttataatagtttactttacgacattttctgagcatttttcctaatattctctttatattctattataaaatgatctgaccgaaggaggaaatccgtcttgttaaaaattttcacgacccagttatcaggtattttttcacgtattggagaaaagcaggctgaagcaatcgaagatggtgcacgccttcttacacaagccgttgtcagtggacatggtgtttattttcacggaaagaatgaactggctgctgtagccttagaggcaactgaaagcaaggagccatttccaggttcgaaagtactgcagcttgatcaaacggagcgcagcttgcttcatccaagcgatagagtgctgctattttattcagacccagaagacgaggagattcaatctcttgtaaaagagctgcacgcgcaagggacgcccgttgtaggtgtcgggccggcacaaaaggagccgtctatgattgaagagcattgtgatgtccatattgattttcagctcaaaaaaccgcttgtgcctgctgatgacggaacaaggttcggttatcctgctttaatgacatgcttatacgtctaccacgctctatcgtttacggtgaaagaaatcgttgaggaatatgaataaaaaaactgccgagaagatgatattctcggcagttttttgttttattttgattcagatgcttgcagtgaagcaccaacgaaatctctaaataatggctgaggtcttgtcggtcttgagacgaattctgggtggaattgagaagcaaggaaccaaggatgatccttcagctcgataatttcaacaagacgtccgtctgggcttgtaccagagaagacaaatcctgcagcttccatttgctgtctgaattcattattaaactcatagcgatggcggtggcgttcgtagaccacttcatcgttgtatgcagcaaatgctttggagtcttcatttaatttacatggataaagaccaagacgaagtgttccgccaagatcatctacatccttctgttctggaagaaggtcaataattgggaatgctgtttcaggatcaatttccgctgaatgagctccttcaaggcctaggacgtttcgtgcatattcgattgacgcaacttgcattcctaagcaaattccgaagaatggcactttgttttcacgggcatattgtgtagcaatgattttcccttccactccgcggtctccgaagcctccaggaacgatgatgccatcgacatcttgcgcgaaatcagccatattttctgctgtcacttcttctgcattgatccatttgatttgaacgtctgcatcaaatgcataaccagcatggcgaagtgattcaacgacagaaatgtatgcatcttgcaattcaacatattttcctactagaccaattgtgacttgttttgagaggttttgcactttatcgactagcgctgtccactctgtcatgtctgcatcttggcaatcaagtttcatatgttcacatacaagcttgtccagtccttgtttttgtaaatcaagcggaatagagtacagcgtgtctgcatcctgacattcgataacagcttttgtatcaatatcacagaataacgcaattttgtccttcatgtcctgggtcattggcatttcagttctgaccacaataacgtttggctgaataccaaggctgcgaagttcttttacactatgctgtgttggttttgttttcagttcacctgctgctcggatgtaaggaacaagggtacaatgaatgtacatgacgttttcacggccaatgtcactcttcatttgacgaatcgcttctaggaatggaagggattcgatgtctcctactgttccgccgatttctgtgatgaccacatctgcacctgtttcttttccggcacggtacacgcggtctttaatttcatttgtaatatggggaataacctgtacagttccgcctaaatagtcgccgcggcgctctttcttcagaacagtagagtagattttacctgttgtaacgttgctgtacttatttaagttaatatcaatgaagcgctcatagtgacctaaatcaaggtcagtttcagcaccgtcatctgtgacgaaaacctcaccgtgctgatatggactcatcgtccctgggtctacgttgatatatggatcgaatttttgaatggtgacatccatccctctatttttcagaaggcggcctaacgaggcagccgtgatcccttttccaagtgaggaaacaactcctcctgttacaaaaatatactttgtcatttcgtatgctcctctcttttttacccttgcatgtctagccatgcacagcttcatcctttttagagtgtatccctaaatatcttgaaaaataagaaagctccctttcaaataaatgaaagggagcgtaaatgaacgtatctttacgtactctttttagagagcccaaaatacatactacatagttcgctctcgaaagtcaagacggttttgtcctgttttgaggaccggtttgtgagggttatttctcttcctcattatcgtctaaatcgtcttcggcaatttctgttaagccgtcatcatcttcgtcatcatcttcgtcgaagtcttctatatcttcctcgatttcctcatcatcgtctaggtcgagatcatcgtcgtcttcaacaagatcaaggtcttcttcaagctcttcgatttcctcttcctcttcaatttcatcgaagtcttcttcaacgacagctgcttttgtttttttctttttcgcttttgttttcacagctggctgaacttcttcttcgatttgatcaactggataccagctgcgaagtccccatctctgatcacctaacgaaataaagcggccatctatatttaagtctgtataaaattgagcaaggcgatcatcaagatcagatttttgtattccttgtaaacggaccatttcatctattaactcggaaaacgtaattggtgttttgctgtctctgaaaatttcataagcaagttcaactaaagacatgtgcttgagctgctcctgtgagtattctttcaaactcaaggtcagacactccctttctattacatgtatgtatccatttatcagtgaaataataagtgtttatcccttatttttacgacaaaccatacctctcattataaacaaattaggggagtttatgccacctttaatcatgttaatttttgattttttctcaaggggagcaactaatggttcatcatttaggtgaaataggtctagcttttgtgtccggcatgcattttgtaaaccgttttatttattccaaacggaaaaatgggaacaatcaggaccagcaatggtgaatgaataaattttggctatcattcgaacgaagtgattgtccattttttataaagcgtataaaaaggtacacgtcaacgggttcggtttacgtgtacctataatgaaataaattgtataactccttttttctcgagtaaccttgaattcatttttatgtgaataccgttacttcttttcgcaagagttcatgctctattattattcattacagtacagcgactatttcttttcctaaggaaatgaaagcatctataataaatggtgccgcaaagagaatcgatgctttccagttcgcttttttgtattgaaaaaagaacaagatcaacactgctcctatgagtgccgtgaaaagatacagccataaactttgtatttgcaagatccccatacatatgacattaataaacataatgacaatcttaggaattagagcataaaacaaatgacccttaacctctggagcaaagatgattaataggaattttgcgataagatactgaactaataggctgatggtggttagaattgttgtaatgacaacaattagattcagcatcgtttcataggacatatcctctaacaaagctcttaaatcatctagttgcgaaatgtagccattcaactcaatagcaaaagtaacaaaataataattggccataataaaaatgaccaatgatatcaatgatgttattcttggacgttgttccataatagcctcccatcccctatactcacaatgcttgaatgatcgtttaagcgtttattcaccatgctatgggatacatatatgatggttgaaatttttttaatagagagattcactagcctctcagatagcatctctatactctctgaatctagagatgacatggtttcatcaattagtatggtttcccaatcctttacgaataataaagataatcctaccttcgctttcatacccgtagatgctctgctatacgaaccatctaggttaccatcgaaaaattcattcactttccccatttgttcttcagtcggcacaattttaaacgtattccacagaatctctagattttctctaattgtaaatgggtgaataccaataggatccacatttaaataaagagtcgattctttgtttgcctcaatatctccagagtatctcttatctaaaccagctatcattttaaggagagtgcttttacctgcaccatttctccccactaaatgaaagagacctgttggaattgaaaaattcactttatctagtatggtattgtttttgaacttcttcgtacattctacaaattctaatcccacttgaatccccttctctgtcttatagagtcttcaataaaaccatctatgattgatcatgatagaaaataataaagaatcatacccttcaataaaagcagcgataattaggatgactaacgatagtagataataaggaatcatttttttcatgacacctaaagcggctttaattgatttcgtataaattagtgtaaaaagcacatactggcttattccttgataaaacaacatatttggaaattctaatagcccatgaggaattagtttacctaaagcttcttgtgctcctagcgttctaaaacccatcgtaatgacgaaggacgaacctccaaaatccattatttgaaataaaggcgacaacaagaaccctagtaaatacattgcaaagttcgttaagttatgtgttaggactacagacataaattcctggcccgatgttggtggtgctgcttcaaataaatctttgttgacgatattccctagataaatccctgtacctatcagcaatatacagtagatagcgtaataccacagaaaatatttcaatcttttatgtatcattttcctcctcttttcatgaagtaatcgtgaaaattgtaatgcatatgagtaataaaattggcaaggacagcttcagtaacttatgttcataatcgttgattaatagttctgtttttctgaaatatacgaccccaataaagatgattaaaggcagcgataacgtatttttaagaataattgagatatccgacgtgtttatcattactccgactattccacacacactgacaaaaatcagtacgagacatagtaaataaatcgtactggatttaaacctctcgtatggactcacaatcaaagaggcttgcaacgtctcgattcttgccctatcaagcacaatctcttccttcttcgaccctattaagatttctaagatcgtaataaagttgatatagactaaaatgagcgcaggcagattttctattttcgttaaaaaggattgggcgaaataagtaagtactgatactaaggcgcctattaaaatgattaatattttattactagtgatataagataaaaataaatacagaatatttccggacctatattgcttattcgcactttttaggaaggaaagtccagttgtcaaaggtatcctatgagaattacttatgtaaatgtaaataagaagaaactgtactatttgcagtatcatcactgcttcaaaaacagacgttatgatataccaaaattgcaacaaaaggagtattctgttgatgatattgaatagacctgacaataattgagatgcaaaagaaagcatcacgacaataaatgctagtatcataatgaaatattgattttctactaacaaaaaggttaaagcaatgaaacaagccaaaagtaattgaactgaatatccttttttaatcgtaaagaataaatgtttcaacaacaattgtttggagacaaagaccacgcctggctgctgtcttctatacggtaatacacaacgattaatattggctgtagctacaatgtatattgaaataaaaacaaagctatttaggtacgtgccgggaatctcaccccgatagaaaatcaacgctaccattacaatgaaagaaaaaagaatcatcccaatataattgaggtaccccattatactttgatcatatattttaaatagtttattagttttatgcataagtcatttttaaaaagcagctgctttggcttttccttgttttttaattacaaacaaaatagcagcaactccagtactaacacatagattggctactgccaaagaaccatttccaacgattaaagatgccattgtaatagcaaataacaatagtgagaataatccaagattttttgcttttaacataaaatttcctcctaattaatgttttattacaagccgcatgggcataaaacgttaaattagtttttaagacactgtctatagaaagttgtttcatctgatatcaatacactttttgaaaaaaaatcatctcaataaagattgagatgatttttttttagattaaaaagcagcagctttcgcttttccttcttttttaagaatagccaagatagcagcagctacacctgaactaattgtgcctacgccagtgaaaacaccaacaattgtaatgacagtcgctactgaggaccaagtatctaagaaattcactactgttgccgcagttgcagtactaacacccagatttgctgcaatcaaagaaccattaccaatcactaaagctactaatgttaccgcaagaagtgacagcgataataaagcataaaacttagaatctgttgctttcgtcataatatgacctccttcgattatttactacttctttagtctagcaagaagtaaatgacatttcaatatttttttggaaaatttgtaatatttatttaattaacggtatttgtaatcagtttttatcaggatttacgttcattttccatttttacagggaacttatgtaatagcataaaatgctctgattcattaaaatctagtcagaatttctgataaacactatcaaaaaatcaattcgtttcaaatcttcagtgccttctcttagagacaggtaagctgttatgatgaattttttaagagatgctcgtttcctgcttgtagtacttcaattattactgaggtattcatcaacaatcggatatcatctcgttaaaaacagagccctagatcaaaaattctctgaatgatcatgttatggatgtgaaaaaagagtggattttattttgaattcaagagaaatgatggatggaatgggaagtacagttatacacattgaccctaaggagagaagaaccgtatcctgtattaggaagcgattcatttttggaaatatatcaggtatctttatacatttcagttcctatcatagcttttgaaaaattgtaacatttagaaaatgtgataaacatactattctctaaaacacaacataagtccctgcaaatcggagtcaaaaaaggggggaatagattaaattacctagttaaattgaatcaatttcctcaaatccaaaaaaatcgagacactcatattgagttgtctcgacttcgatttgatatcaaaatagatacccattattcaaatctttgaacgtatgatgaaaaataatggctgctttttgcatgaatcgtctgtatagtcatttctttagatccagatatttatgtaggcagaatcataaccatcacgttagaaatgaagctgagccctgacatttctgcaaagtttaaacacattggtgaatgagatgaacttgttatatagttctcaagcattgaaatatgctctcataacgatacacttttatagtttattttaaagctagagattctgaagtaatgagatgactactgctatcgtcaatataatgcctgcaagcattaaaacaattaattttctacggctattttctttttcgttgtgatctttctttgaagacttcgaaagttctgcggaaaccatgatccatatcaccaaagttacaatcgctaagatagtagtagttgtggtcataataacctcccatatttttattttcttaattttaacataaggctaatataatatggatcgatactggaaatcatcttaaattcaggaaaacctgactattaccttgtatgtgggttatcgctatatcattcttgaggtctaattctttagtaggtatattgccaattcacatgtaccaatactcactacttcaccagttacaaatcgctcatacgttaaaacggtttcctgttgccgacactatccttttacaatcctaaaataaaaaaactttggatgatgctaatgattaatgcttcaagaaccaaaccaaaacagaccacctcacatcaggtggtctttgctttgtttctacatatctatcagtttgcgcgagatgactaggcgctggatttcctgtgtgccttcataaatttgggtgattttcgcatcacgcatgtatcgttcgactgggtaatcctttgtatacccgtagccgccgaagatttggacggcttctgttgttactttcatggctgtatctccagcaaagagcttggacatagctgattcctttccatacgggagccctttcgtttcgagccatgctgcctgataagtgagcagcctggatgcttcaattgcggttgccatatctgcgagcttaaaagcaattccttgctgctgaatgattggtttgccgaattgcttgcgctccttcgcataatcgactgccgcatcaagagcgccttgtgcaatcccaacagcctgtgcagcaataccgtttctgccgccatcgagggtcatcatcgctattttaaaaccttctccttcttgtccgagccggttcctttcatgtatccggcaatcttcaaatcgaatttcagtcgttggcgatgagcgaatgcccagtttgctttcctttttgccaacagagaatcccggtgtctctttttctacaataaaggcggtcttatttcgagatgcagcttcttggtctgtcacagcaaacacaatataataatccgcaatacctccatttgtaataaagattttcgcaccgttcaggacgtattcactgccagcctttactgccgttgtcttcattccgccggcatctgaacccgaactgctctcagtgagtgcatatgcccctaccttctgtccttctgcaagtggctttaaataggtttccttttgttcatctgttccgaaggtatagatgggccacgaggcgagagaggtgtgggcggagagggtgacgcctgtagaggcgcacactcttgaaagctcctccactgcgatgacgtaggctaaataatcactaccgattccgcctacttcttccggccaaggaatgcccgttaaaccgagctccgccatttggctaaaaatagctggatcatacgtttctgtctcgtcccgctctgctgctgttggctctacttcatttttcgcaaaatctctcaccattttttgaatcatttcatgttcatcacttaattgaaactgcatcatgagccacctcgtttcatattagctgtttacaaatgaccagcctttgaatttcactagttccttcatagatttcacaaactttcgcatcacgaaagtaacgttctgcttgatagcgattcgtataaccgtccatgccgagtaaatggatcgcttctgtactgatctcaaccgccgtttttgacgcaaatagctttgccatggatgcttcctttgtcaccggacgattcgcctctttataacaagccgcttgatagactaatagcttggcagcttcaaacttcgccgccaaatcacccagccgaatggtcgtttctagacctgccgggtgctgctttaaatacgtcactgcctccgttaaagcagcttcagctataccgagactttgagccgcgataccgattctccccgcatttaaactagacatggctatgtgaaagccctctccttctgcaccgagcagctgctgttttggaatccgtacagcatcaaaatgaagcgtgacagtttttgacccgtgcagtcccatctttttctcatcttttccgatcgtaaatcctggtgtacctttctcaacaatgaatgccgatatattttttttcgcagaagcaggatctgtcacggcaaagacaagatacagttctgcttccccgccgcttgtgataaacatttttgtaccatttaacacataatggtcgtctgcccgctttgcccttaactgaatactggaggcatctgagcctgccttcggttcagtcaggcaaaatgctcccagtttctgcccggatgcaagcagcggaacataggactctttttgctctttcgttccaaaagccaaaataggcatcgtcacaacagatgtatgaacggacacaatgacaccgatggtcgcactcactttggataactcatggatagtgatgatatacgttgtaaaatctgctcctaagccttgatacgcagctggtattggaatccccagaaagccttgtcgtcccatttcagttaaaagtgctcttgggaactgaccttgttccatggcttccacttcagggaatacacgctgtctagcaaattctgctgcctgttctctccagagacgctgttgatccgtaagcaaaacatccatcttgactccccctatgagtggtcgtggtatgtgtaaaaacctctctttgtctttttgcccagccagcctgcattcacgtattttttcaaaagaggacaaggccgatatttgctatccccaagtccctcatgaagggtattcataataaataaacatgtatctagtccgatgaaatcagcgagacgaagcggccccattgggtgattcattccaagcgtcataacaccatcaatgctttctgcatctgccacgccttcataaagggtgtaaatggcttcattgatcattggcatcaatatgcggtttgatacaaaccctgggaagtcttccacttcaattggggttttgtttaaattctttgctgtttcacaaacgatttgatacgtgtcgtcactcgtttgcagcgctcgaatgacctcaacgagtttcataacagggacaggattcataaagtgcatgccaatcacttgctccggtctccccgtaactgctgctaattctgtgatcgacaaggaagatgtgtttgttgcaaatatcgtcttcgcctctgcaaattgatcaagtgtttcaaagatttgtttttttacactcatttgttcagatgcagcttcaatcactaagtgagcctgctgcacgtcctttaaatctgtagatacagcaagccgctgcgtaatatctcggactgcctgatgggctagctttcctttttctgcccgtttcgtcagttgtttggtcatggaggaaatggcccgatgaatctgcttttcagatgcatcatgcaacaggactgtgtagccagactgagcaaaaacttgggcaatgcctgatcccatttgaccagctccaacgaccatgacggtttcttctgtactcatgacgatgaacgcctcccttttaatctacctttatcatgatggcatctccttgaccgcctccactgcaaatcgccgcaatgccaataccgccgcctctttgtttcaatgcatgaatcaaggtcaatataatacgtgttccgcttgccccaatgggatgaccaagcgccactgccccaccgttgatattcattttgcgccggtccagcccggttattttttcacatgccagcgccactgctgagaaggcttcattgatttcaaatagatcgatatcctctagacgcttgcctgttttttgtaaaattttctcgatagcaaaggctggtgttttcggaaaatcctttgcctctacagctacctgcgtatgaccaagcacgactaccaatggcttgacgtcatgctgctccgcatatgtgtctttcattaaaagaagcgcacttgctccatcattgacacctggtgcattcccagcggtaatggtacccgtttgatcaaacacaggcatgagttttgacagccgttcatatgacgtatcacgccgcggagattcatcttctgtcatcagccgctctcccgttttcgtcttgacggtaacgggggtgatttcatgctggaaaaagccgtttttctgcgcttcgatcgcccgttcatgacttcttaatgcccaaaggtcttgctcttccctcgtgataccgagctccttcgcagccatgctcccatactcacccatatgaacgcctgtaaatgaacaggttaatccatctaaaatcatcgcatcttgtaccgcaccatctcccattttgtagccccatcgcgctttttttagcaaataaggggcgtgtgacatggattccataccgcccgctacaatgacctcagcatctccagctcggatgatttgatctgctgtgctcacactgcgcattcctgatgcacagactttattgatggtttgcgtcggaacggaccacggaagatcagcatgtcttgctgcttgtcttgaaggaatctgaccttgtcctccctgcaaaacacttcccatgatgacctcatccacatgatgtgaacctggcactctttcaagcgcagccttgattgccactccgcctagttctgcggcagtcagcccactgaaagcaccgcctagttttccaaatggtgttcttgctccagatacaatgactgtcttactcatgtatgtcccctcccgtttgttaccgcttacatattatctagtcagctgatgtacagcgccatgtataagccgatgaacattctattcatcggcctgttttgtttacgaaacctgctttccagcctcgccaaacactgatttttcaagaagctctgcgacatcaaatgtacctacctgctcctctacttccttcgccttcgtcccatctcccagcatcgttaagcaataaggacaccctgagctgatgatggacggctggacctgtaacgcctgctccgttcgggctgtgttaattctggtacctgtctcttcttccatccacattaagcctccgcctgcaccgcagcacatgccggtttcacgatgacgttccatttctttcagcgtcacaccagggatggcttttaaaatgtctctcggcggatcatatacttcgttatatctgcctaggtagcaagagtcgtggaaggtgatgatctcgttcacttcatgtacaggcgttagtttcccttctttcactagctctgccagtaattctgtatgatgatacacttctgcctcaagcccgaagtctggatactcatttttaaacaaattgtaggcgtgcggatcaatcgtgacgatctttgtgacatcgtttttctggaattcttcaatgttttttgcagcaagctcttggaataaaaattcgtttccaagccttcttggtgtatcaccagagtttttctccttattgcctaggatggcaaaggagactcctgcttcgttgagaagctttgcaaaggcaagcgcaattttttgacttcgattgtcatatgcccccattgaaccaacccagaataaatattcgaaggtttggtctgcttttttcagctcttttactgtcggcacgtgcacaccttctctcagttcacgccaattttctctttctttccggttcaatccccacgggttcccttggcgctctatacttgtcatggcacgctgtgcatctgcatccattttcccttcagtcagcacaagatatctgcgcatatcaataattttgtcgacgtgttcattcatgacagggcattggtcttcacagtttcggcacgtcgtacatgcccaaatttcttcctctgtaatgacttcaccaataagagaaggatgatacatcgagctggcagccgattcctctgcacctgctcctctcgcctgaagcgccagctgatttcctgttgtctgcctgaaggcaagctgcggaacccaaggcgtcttcgatgtaatggcggcccctttattggttaaatgatctcttagccttaaaatcaaatccataggagacagcattttccctgtccctgtggctgggcacatatttgtgcagcgcccgcattccacacaagcgtaaaggtcgatcagctgtgactgacggaagtcttcaatttttcccacaccgaaggtctcttgtgtctcatcttcaaaatcaattttttgcagcttgcctggcgggtctaatctgctgacaaatacgttcaccggtcctgcaatgaggtgagcatgctttgactgcgggacatagactaagaatgtcagcaaaatcagaagatgcacccaccatgcgacataaaaaacgactgttgccgcaagaggtgaaataccgcccagcaagaaagcaatactggatgcgattggctcagttggtgataaagagtgtccatgccagatgatattcatcccgttcccaagtaaaacggtcagcatcaagccgccaataaataaaagcactagacctgatttaaagccacgctttaaacggacaagcttctccacataccttctatggaacgcccaaacaacggctactaaaatgagaagtgtgaccacctcttggaaaaaggtaaagacaccataaagcggacctaaagggagtccgctatctggaacgagtcccttcataataaaatcaagggctccgaactgtacaaggataaatccgtagaaaaacagcacatgaatgatgccgctcttcttgtcctttaacagcttcttttggccaaatacattgacccaaacacgctctaagcgttttttcatgtcttgttgaaactcttcttttttaccaagacgaatataagctgctcgtgttcgaatgagataaataaacaaatacacagcgtaagcggtcaccgccgcaaatgcaatcatgttcatgattaaaaggctattcatcttgctccccctttcattccccaaaacctactttgttccgtttccatgttgtacctctatcataaataatgaatgagtgttcagtcaatattttttacacgtttgggtacactattgaaatatgcaaaaaaggaggaagattcatgatcgcattgatcatcctactcgtactcattgtcatcgtttgtctcatattgttagacctttatatgggaaagaaatatttttctacccgcgcttttgaacgatcttttgaccaaacaagcggtgatgccgtcttttatcatgatggcgaaccattttttgatcagctgctcgcggatattcaacaggcctcttcttctattcatatgatgttctttattgtaaagaacgacaagattggtcaaagggtcttacaagcactgaaagccaaagcggaacaaggggtttcagtctttttgctgaccgatcgactagggtcctatccgtttgatcaaaattccattgatatgctggaaaaaagcggcatccaattttactttttaaataagcctcgtttcccttttttgatttatcggttaaacatgagaaatcatcgtaaaatcacagtgattgatggaaagattggctatattggcgggtttaatgtcggtgatgaatatgttgggaaaaagggtcggtttggcatttggaaggattatcatttgcgcatgacggggcaagttgtcgcagatcttcagcatgtgtttttgaatgatttataccggacatctggcattcatcagctgcaatatgaagtttttcctgctttggaacccggtacactacaatgcacaacacgtgcgactgctggtttttctttagaagctttgttcctcaaagatattcagcaggcgaggaaacagatcatcatctgtacaccttactttattccatctgctcctcttctgagtgcattgcttgatgcacgaaagcgaggcgtcacggttgaaatcatcatcccaatgaaagcagatcatccacttgtcaaagaggctggatttcattatttgaaggacctcattgcctctggctgccttgtttatcgtttttataaaggattttatcatgcgaaagccattctaattgaccagagacgctgtatgatcagtacggcaaattttgataaacgcagcttgtttctaaacgaggaagttgatgtcgccattgacgatgtcgactttactgcacacgtagaggaaaaaatccgcgagcacatagaagtgtctgagcttatgacagaagagaaattggcacagcgtcctcttttgtctcgtccgctggaatgggctgccgccatgttttcttattttttataaaggagatcacctatgcgttatcgatttggttatgtatccaatgccgtcaccttgtgggagacttctcctgccaagtcgctgtcctttgcaagatacagcaagctctcaaaggaagaaggaaaagaggcgttattacgaacaacaaaggccaatctcgtgaatacattaagaacgctttatttcgccattgctcatgatatcccgctttaccgtttttcgagttcgatcgtcccgcttgcgacccaccccgaggtacgctgggactttgtgacaccatttcaaaaggagtttcttgaaattggcgagttggtaaaacggcatgggcttcgtgtgagctttcacccaaatcaattcaccttgtttactagccttaagccttcaatcacagaaaatgccgtgatcgatatgacgtaccattatcaaatgcttgaggcgatgaagctcgaaaaggaaggctatatgaacattcatgtgggcggcgcatatggtgataaagaatcagcacttctccgttttgatgaaaatatcaaacagcttccggcgcatatcaaggcgaggatgacgcttgagaatgatgacaaaacgtatacgtcgttagaaacgcttggtgtatgtgaaaagcacggtattccctttgtttttgattaccatcatcacgtagccaataaagatgacgatgccgcccttgaagacatcctgccaagagtattcgacacttggacgagcactggcattccgcctaaaattcatttatcctcaccgaaatcagaaaaagccatacgcagtcatgcagatggtgtagatatgtcctttgtcttaccgctttttcatgcattaaaaccgtatgggcgtaatgtagattttatgattgaggcgaagttaaaggatcaggccctgctcaaactcgtcgaagaactgtctgcgataagaggcaacaaacgaacaggcggaggaaccattgagtggaaatcatagagaaaggtttatctctgtgcaaacaggggtaacaaagctattgtgagaaagtaatcaacaggaggatatgaagatgtctcagatctattcaatccaaatcgctgcgaaagcattgaatttacataagcttatttctctttatgaaaaatgccaccaagctcaacatcgtctatatgtgtattctaaaaaaacaatgtgtaacatcaagaacatcgtagagcttgaaaccttcaggctcattcatttagaatctgactacttaattgtcgtagagggaaaaaaagcacaagacctcttgcagccatttgaaaaagagaaggtttcttaaaaaagagcagctgctggctgctctttttgttagatccactctttcgtcaaccacacttgttttgaaattgcatccattttcacttgtgcaccgatcggcatcgtgagcatcgggtgtgtatgagcacagtcaaaatctgcgataagcggtctctttgtctctccaagcacctcaagtaaaatctcgtaaggttctttgcccgttccctcatcatcaaacagctcatgtttccccaatagaattcctgatacccgctcaaacactccatttactttcaataaagagaagtttttttctacaactgaagcagttttcatgcaatcttcaatgaggagaatgtctcctgtttggattgcaggcatgaattcactgccccatatgccgtacattgcattcaggttcccgccgattaacctgccttctgcctgtccttctaggacgcacagccaatcattcggacgctgctttttatcacgcgtcttttcttcccaattgattcgttcatccgtccaaaaaggtggttttttaatctgataaggaatgggttgaggctgcatcaggatgtcttcgaacgactgatatgaataagcaacgaacggttcaaactcgccaaaggacgggacaagcgccggtccgtagaatacaggcagtcctgttttttcgtaagcggctaaaagaattgctgttgcatctgaataaccgatcatgattttcggatgttgattcagcagctcaaaatcgagataaggcagcaaactatttgaatttgtcccgccaatcattgacatgacgcacgccaagtcttctcgtgccattagctcattcaactcattggctcgttcttgaattgtacctgaacggtagtgatcctctttccctgttaatgatcctggtaccacaatgaatcctttttgctcaagccacttcttcgcccgctcatacctaagtggcgaggtcgctgatgcaggacttgaaggtgaaaaaataccgatcttatctcccttttgtaatcgccgaagccccttcattccatcagatccttcctacacgagttttttctatcctaacaaaaaaagcccttgatcaaaagggctttctctttaatgaccaaactgcgcttcatgcagtctgctgtatacgccgcccatgtgaattaaatcttggtggcggccttgttcttcaatgccttcctctgtcacgacaatgatacggtcggcgtgtttaattgttgcaaggcggtgggcgatgacgagtgttgtcctgccgactgccagttcactcagcgcatcctgtatggctttttctgtttctgtatccagtgctgatgtggcttcatctaggatgagtatagaagggtttttcaggaacattcgtgcaattgacaagcgctgcttttgaccgcctgacagtttgacgccgcgctcacctatcaccgtattcaatccttctgggaaacgctggacaagttcctctaaatgcgcacgcctgacagcctcccaaacctctgcatcgctggcttctaggttgccgtacgcaatgttttcacgaatggtgcctgagaataaaaagacatcctgctgcacaataccgatctgctgccttaaagaagacaatgtcatagactttgtgcttacaccgtctatcgtgatctccccttcatccacatcataaaaacgaggcagcagactgcaaatcgtcgatttccccgctcctgaaggcccgacaaacgcaaccgtttctccttgtttgatcttcaaatcgatattctttaacacatgactgtgttcatcgtagccaaatgttacgtttcgatattcaatctcacctttcaatccgtaaacatcacgtgcttcctctgtatccttcacatccggctctgtttctagcaaatccacatagcttttaaagcctgcaatgccttttggatacatttcaatgaccgtgttgattttatcaattggtctaaataaaacattcgtaatcagaacaaatgcgataaagccacctgccgttaattggccttgcaggacaaaccatgtacctgcgagaaggacaaacagtgtcacaagacgtgtcagaatatagctgatcgatccattgaccgacataattttataggaaagaagcttcgctttccgaaaacggttattgttttcagcaaaacgctttttctcaaaatgttcattggcaaaggcttgaacaagacgtatgccgccgatattgttttcaacccttgcatgaaagtctccaatgtcattgttgagctgtgtaatcgccttcgtcatctttttattaaaatgaagggcgagccaaatgatgacaggcatgatgaggaaggttaaaatagccagctgccagttaatcatcagcatgactgcaaaggcaccaagaatcgtcataatcgctataaacaaatcttcaggaccatgatgcgccacctctccaatgtacatgaggtcgtttgtcatccgtgacatgagcttacccgttttgttgttgtcaaaaaatttaaaggataggcgctgaaagtgatcaaacagctttttcctcatatctgtttcaatattgatgccaagcatgtgcccccaatatgacacaataaattgcatcaccgagctgagggcataaatgacaaacagcgcaagtgctgtccagacaatgactgtccagttccctgttggcagcagtgtatcaataaagtagttcacgataagcgggaaacccaattccatcaatccaacggcgacagcacaaaagaaatctaaaaagaacagacctcgataaggcctgtaataggcgaaaaagcgttttagcatatgtaaaagaacctcatttcctctataattgaaaatcattttcaattatagaggaaacctcttcaaaatactagatgaggaaatgatttcttagactggaaatcctcatagcacgccagaaaataaccgagcaaatgattcctttaagcgctcttttaagcctcttttataaaaatgaacaggccccatttgctcacattctttcatatcctcttcataatgggtcattagctgctcaatgggctttttcgcggccgtaaagacattgacctcaaaattgagctgaaagcttctcatatccacatttgcggtaccgacagaggcaagttctccatctgcgatcatcactttttgatgcatgaagcctttttgatagtgatacactttgatgccctcttttaggagctcagaaaaatacgatcgtgtggcgtattgtgtgagaaagccatcattgatctccggaaccatcacccggacatccacccctcttgtcgcagcaattttcaacgccgtacgtatggattcatttgggacaaaataaggtgtcgcaatccagacaaattgtttcgcatttgagatgagtgcatcatataaatcactcatactttctttcatatcgggtccagttggtacaacctgaatgacatcctctcccgtcacaggatgcggcatatgatatttcggatcatcaattaatacttcatctgatacatactcccagtcaagcataaaaacagagtgaagggtttggacagcctcaccctttaacatcgtatgcgtatcacgccaaaacccgatattttcatcacgtccgacatattcttttccgacatttaaccctccgacaaatccagtttgcccatcaatgatcacaatttttcggtgattacggaaattgaatttttgattaaagaaaccatattttaaaggcagaaaaggagcaaccttgacacccgcctgcttcaagcgtttaatatctttccgagaaaagcgaatgctgccagccgcatcatagatgaagcgaacctctaccccttctttcactttttctatcagaatctccatcatccggtgcccgaggaaatctgatttgaacatgtagtattctatatggatgaacgattttgccttttttaattcttcaaaaatacgaggaaacgtctcctccccattttttaaaatgtccatgtcactatttgtgttcacatgcatgcctgttgctttttctgtgtaatgaaaaaaagtccgctgattttcggttagacttgattcatccggcttgctctcaagctctgatattctgcgtagtttttcacggttgtacattctctttgatttgaataaatgacctttcacatagagctgtcccgagaacaaataaaacatatagccaatgatcgggaaaaagatcagcacatacatccataaaagtgtgtgctgtgatgtacggttctctagcatgagtgagatgatactaaataaaataatggcgatataaactgctgcgtacagctgaacactccacgctggcaccggccaccaatacaccacatatgccccgaatatcataaaatataaaaataaaaattccagtctcctctttttcacattctccgccctcattcgtttctgtcttttctcttccataccctttgcacagcttgtatgaaacgcacgatccattcctttttcctagcctttacagacttgcgctatttgatccgatataatggagaaatatgtgatggaaaggaagatttgtttatgcatacaccctctcctttaaaaaaaggcagccatcttcgtgtcattgctccaagccgaagtgccagcattttatcaaaagaaggaatcgctcaagcaaaaaagcgtttagagatgttaggtttcactgtttcctttggacagcacgcatttgaatgtgatcttcattcctcttcatctattgaacaccgcttgtctgatttgcataaggcgttcacagatgaagaagtcgacggtattttgactgccattggaggcttcaattgcaatgaacttttgccttacattgattacgacttgattcgtcagcatcctaaagttctttgcggctacagtgatattaccgcactcgcaagtgctattactgccaaatgtgagatggtgacatactctggaccccatttctccagctttcaaatggaccagggacaagaggagcagaccgctatgtttcaagcctgcttgatgaatggcagtgagtgttttgatgtgaccccttcgacaaagtggagtgatgatgcgtggtatcttgatcaagcgaacagacagtttcatccgacgaaatggggaatatatcaggaaggaacagccgaaggcaccttgtatggagggaacctttgtacactgaacttactgcaagggacaacgtttatgcctcgcatcaaggatgccattttatttgtggaggatgatgacttggtctttcctgaaatgttcgccagagaccttgcctcgcttttgcagcatgccgaatccattaaagggttgatcatcggacgctttcagaagaaatccaagatgacagaggaacatttaaagttcattttagataaacacccaatgctcaaacacattcccgtgatctacgatgtcgatatcggacatacgcagccggttttcaccttaccgattggcggaagcgttcagttagcgtgtgaaaatggagacgtgaagctgcgcattcattcataactaataaaggcaaaaaagcacccgaatatgtggtgcttttttctatgccaccatcttttttaaaattttttagaaaaagtgatccaatcctccatccccttcgttaagtagatgtaaaaagaaaagagaggaggcaaaaacatgttctctgatgtactaagccaattattcgattctatctctaacatgattaatacacttggataatcccattaacgcacacatactacatgcttgccgaagggaggatacaaactatgttttctgatgtacttagccaattatttgattctatttctaacatgattaatacgcttgggtaatgttcaacatccgctgtccttaaaagatagcgggtttttttatatcaaaaagccccactcctatagtagagcggggcttttttgtattacatcttttccggagccgatacaccaattagtttcaatgcattcgccagcgtaatttgtgttgctttcatgagtgaaagacgtgctgttgtttttgtttcgttttctacatcaatgaccttttcggcattgtagaagctgtgaagggctgatgcaaggtcatagatatagttcgtcacacggtgcggaatacgcttttcagctgcttctgctacaacttctgggaagctgccaatgattttgagaagatcgtattctttttccgattgaatgtgagagaaatctgctttttcaaggtttggctcgtagcctttttcttcaccttgacgcagcatgctgcaaattctcgcatgggcatattgtgcgtagtacacagggttttcgttagacgtagaaatcgctaaatctaagtcaaagtccatatgtgtcgccgcacttctcatcgcgaagaaataacgagtggcatctaggcccacttcttcaatcaagtcacgcatcgtgacggctttacctgtacgcttactcatcttcatcttttcaccgtttttgtataggtgaacgagctgaatgatttctacttcaagcttgccagcaggatatccaagtgcttgaatcgccgctttcattcgagggatatagccatgatggtccgctccccatatgttaatgagctgatcaaagcctctgtctaatttgtctttatgatatgcgatatctggaagcaagtaagtgaagctgccgtcttttttaatgagcacgcggtccttgtcatcaccaaaatcagttgaacgtagccacgttgctccatcttcttcaaagacatagcctttagcgcgaagggtttccagcgctggttcgatttttccgttttcgtataaagaggtttctgaataccatacatcaaatgggacacggaaattctcaaggtctacgcgtaatttctctaattcgtattttaagccgtattcacggaagaacttcatacgctcttcttctggctcatgcacgaaacggtcaccaaattcatctgccagcttttgcccgatgcctttgatgtcttctcctctatagccgtcttcaggcatctctttttcaagaccgagcgcctcaaagtaacgtacctctacagataaagcgaggttattgatctgattcccagcatcgttgatatagtattcacggctcacctcgaaccctgctttatccaggatgttgcaaagagaatcacctacagctgctccgcgggcatgtccaaggtgaaggtcacctgtcgggttggctgagacgaattcaacttgcaccttttgaccgccgcctgtattcgtttcaccatatgcctcttttgcttcaaggacagctgggattagctttgttaaatactgattgttcatataaaagttaatgaatcctggacctgcgatatccagtttttcaatagatgctttccctttatcaaacgctttgacaatgtcctctgcgatttgacgaggtgctttttttgcaatgcgggcaagctgcatcgccatgttggtggagtaatcaccgtgagttttgtctttcggcacttctaaaaggacatctggtacctggctttcatcagcaagtcctgctttgacgactgccgcgataatttcttcttttaacgcatctttgacctgttctgcgatattcatgaacgtaaatcctccttatatgaaatcgataatgtatgtaaatgcttttgatcttcccctgtcagcatatcgtacgtaatgtgcagcagccccttgtccacatcgagatcaatgccatgtgtgtgtacatcaagctgtagtgtaccgaatggcatcgtgtaatgtgtaatggtcgtttctccgatgagaaagcgctgcttcatttgaatggcccctgatctcatgacaaaaatttctttttcactcattttcacaacggtttttacttgacccatttcatgttcttcatggtaagtgagatacgttttgtcattcttttcttgatacgttccagtcgtgcggaattcgatcgtttcagccggctccgtctctggtttcatcactgactttacatgaattgaaatttggttttgtgtcattttgcacttcctttgctaagacccgtttaactaaaatagtataccatattcatgatcgcctatcataccatcatttctcttcttcacggtgattaaacttcgttttcgatcttacgccatccctttagaaaaaaagaaacaggaaactcactaatactaccaatccagcctttacgcccctgtcttttcttttgatgaaataaaaaagagcttgtacgcctgaacttgtcaaaaatgcctgaaaaaaatcaaatggcacgatctgcgactgcttaaataccacctgcatgaataacgcaatggctgtcagatagaaaaagcttcgatcctgaaacagccccaacatctcttcctttgcttcctttttcgaagcaaaaacaggcggctcagctgcgagctctcgtttcagtgtgagaaagcctgcccctaacacacataaagcgagaagcaccatcaatattgacgaaaacatgagctgcctcctttattttttgaccaatgtaaaaaaaagagcttgtccatatgagatgacaagctcctctatcaagttattatttcacaaatccaagcagcatttcgcgtaaaagcttgctcgctgtatttgctgtttggtcggaatgatcgtatacaggtgctacctctacaaggtctgcaccaactacttgaacctcagatcctgcaatggcatgaatggaagcaagcagctcttttgatgtaataccgccagcatccaccgtgcctgtaccaggtgcatgagctgggtcgagtacatcaatgtcgatcgtcacataaactggacgccccttcagctttggcaatacttgcttcaacggctccagcacttcaaatttagaaatatgcatgcccgcttcttttgcccattcaaattcttccttcatcccagaacgaatcccaaaagagaacacattttcaggtccaatgagtcctgctactttacgaatcggtgttgaatgagacagcggctcaccctcgtattcctcacgaagatccgtatgtgcgtccatatggataatcgccaaatcaggatatttcttatgcatcgcgcggaaaacaggccaagacacaagatgctcgcctcccattcctaatggaaacttccctttttctaaaatgctgtcgacatactcttcaattaagtctaagcttttctgtgcatttccaaaaggaagcggtatgtcaccggcatcaaagaatggtacctcgtgcagctcacgatctaaataagggctgtattcctctaatccaatcgacacttcgcgaatacggtttgggccaaaacgtgagcctggtctataactgacggtccaatccatcggcatcccgtataaaatgacttttgcatcttcccatgtcggatgacttccaataaacacttttcctgaataagcctcgtcgaatctcatgcaagattcctccttttacgcttcaaaaaatgcgcaaactgtcatttgcgcatttccacttcgcttgatttatttgattaagtcgcttacaaatttcggcagaacgaatgccgctttgtgcaattcttttgtgtaatatttcgtgtcaatatcaaagaaacggctgtcttctacagcaagtgggtcatatttttttgaaccgatggtaaatgtccaaagaccacttggatacgttggaatatttgcagtgtaaagcttcgtgattgggaaaatctctttcacatcacgctgtacatttgtaatcagctcaggtgtgaaccaaggattgtccgtttgtgccacgaaaataccgtcttctttgagtgcttttgaaatccctgcgtaaaagcctttagagaacaggttcacagctggcccaactggttctgttgaatccaccatgatgacatcatactcattgtcagcttcagcaatgtgcataaagccatctccgactttgacatctacacgaggatcgtctagttttccagcaatcgaaggaaggaatttcttcgagtattcgatgactttgccatcaatatcaacaagtgtcgcttttttcacacttggatgcttcaggatttcacgaatgacaccgccgtctcctccgcctacgacaagaacattttccgggtttggatgagtaaaaagaggaacatgtgccaccatttcgtggtatacaaactcatctttctcagatgtcatcaccataccgtctaaaaacagcatattgccaaactcttctgtttccaccatttctaaatgctgaaaatctgtttgttctgtatgaagggttttgttcaccttcaatgtaataccaaaattcttcgtttgcttctctgtataccaaagttcgctcattgtccatcttcctctcatccaataataaacaaacatctattgttagcgcctttatcggctatgactatatcgattgtccaagaaaaaagtatagtggattcatatcaaattgtaaagaaccgcatgagttctcttcaattttcatgcatactcttgcaatcatttgtttaaaacggttttctttgttccatactgataaaaaaccgtcaaaatgggggctttgcatggacacaatcatgagtaataaaaaaatccgcatgaccgtgaaaacgattcgagcctgtttttttattggcttgctcgcttttctatttgcaggcactgtctttttgacgattcttttaatagccaaatggcaaggtgccccctctgttcaagttccccaatctacgacgatttatgcagccgatggttcaaagcttggagaatccagctttggagaaaagagatattgggtgcccttaaaggacatgtcccctcatatcagacaggcagctgtagctgttgaggataaaaccttttatgagcatcatggctttgatgtgaaacggatggcgggtgctgcagtggcggatattcgtgctatggctaaggtacaaggcgccagcacgatcacccagcaatatgcacgaaatctgtatttagatcatgataaaacgtggaagcggaagtggaatgaagccttttacacgatccgcttagagcaaaactatacaaaagacgagattttagaaggatacttgaacaccatttattatggtcacggagcttacggcgtggaagcggcgtcccgtctgtatttcggaaaaaaagcgaagaatttgacactcgctgaatctgccttacttgccggtatcccaaagggcccttctctctactccccttatgtgaatgaagagaaagccggcgcaagaaagaatatgattttgaggcacatgcaagaggatggcatgattacgaaaaaggcagccgctgaagccgcgaaagaaaaactgtcctatcgccctttgcagaagaagcagctgcaagcaaagcaagccccatatttttatgatgatgtgattcgtgagttgaaacaaagcttggggttaactgaggaacagatcgaaacttatggtcttcatatccaaacgactttaaatccagagttacagaaaatggctgagaaaacgttacaaaacacaatctattcgaaatcagacatccaaatcggctttactgctatccatccccaaacaggtcatgtactcgccctcatcggaggaagagattatgagaaaagtccattcaaccgggtcacacaagcgaaaagacagcccggttcaacaatgaagcctcttctctattacattgccttgcaaaatgggtttacaccagcaaccgtcatgcgaagtgaagaaacggtttttgagctcgatgatcaaggaagcggtgctgcttattcaccaagcaattatcatggctattacgccaatgacggcattaccatgcttcaagccttggcgctgtctgataatatttatgctgtgaaaacccatctttttttaggaatggagcagctcgtacgtgccggcaaaacattcggcatcaacgaaagactagatcaagtgccgtcacttgccctaggcacgtcccctgtcaaaccaattgaaatgaccaatgcttacgcaatgcttgtcaatggcggaaaacgagtcaaacccacctttattacaaaagtaacggatgcaaaaggtaacgtgctttttgaagaaaaacaaaaacgagagcaagtcttagatgaaaaggcagcctttgtcaccaccgacatgatgtcaggaatgttcaatgatcagttaaacggctatacgagtgttactggccgcaccattatgaaggatctcacgcgaacatacggagggaaatcaggaacgacaggagccgacagctggatgatcggcttctctcctcaactcgtcacaggtgtgtggacgggctatgataaagggcgtaccattgactcggtcgaagaaacagcctatgcaaaaaagatatgggcatcctttatggaatcagccctctccaaacagccagcgtcctccttcatgccgccagacggtgtaaaaggtgtgtatatcaatccaaaaaccggcgatctcgcgggtccaggatgtgaatcaaaggtattcacctattttatagaaggaacggagccgacaggtgtgtgctacggtgctgaggataaatcttctgaggaagatccggttcaagatcaaaggccaaagaaatggtgggaaaagtggctgaaacgttaaaaaaagacatgaaaaaccccgagatttgcatctcgggattctccatgtcctagctttaacaccagtttactcaaaaatcagctggaattggtagcaattcgccattcttcacaaaaatttcacaattattcagggacagccaatccttcttttaattcttctgtagatgcttcccatagtgcttcattatgactcttcaagaaatcagccagtacctttttcgatacatcatccatatgactgacgacgatttttcgcttcattgatttatccattaaattcacatgctctggaagcgacttatacccgcggcggattgaacggtcgacggtcatttcgcaagccgtcacacccgcataataaggacctacttctctgcggtcaatggttacccatacgagccaatacggctttccgttcggtacctcttctttacttttcaagaatttaatccctttttccacggcacttcttgcatgcattgcaccaatatcaatgacagcttccttttcctctacatcaatgatcactggcgaaatgttatctaggctgagtgcacccgcaccaaagcctccgtgtccgtcagttgcgtctgtttttttaatgatattaaaaccaattggtttcttctttttaccttccattcattaaacctcctaaagcagcggcttcaaaataagattaaaccagtatatgatttgatcccgcattccgatcaatggaccaaaaacaaactgtcctagcggcgtaatcacgaatatgagaaaaataatgatcccatattgttcgaattgcgtcattttcgcacggatacggggactgacgacgtcctcaataatacgatacccatccagtggcggaagtggcaatagattaaataggaacaaaatgacgttcaagtttataaagattcggaagaaataatccattccaggctcaaagcgcatgagcgactccccgccaaatttctgaagaagcacgtacacgaaacagcctagaaacgccaacaccaagttacttaaaggaccagcaatcgagacgcagattcctgctaagcgcgggtttttaaaatggtatcgattcaccggcacaggtctcgcccagccaaacccagcgacaaagatcaaaatcgtcccaaatacatcaagatgcttcagtggatttaatgtgagtctcccttggttcttagctgtcgggtctccgaaacgatacgcaacatatgcatgcgccagctcgtgcatcgtaaatgcaacaacaagcgtaatggcgacatatggaatcagttctaatggatacacaagaaattggttcaaaggcatgaatccctctttctttctatacaatgatttacttcattcagtatactataagaagtcccttaaactaaagggaagcgtagcattaaaggaaaaaggaggtttttgcattgccgattgttaccgtacaaatgcttgaaggaagaacagacgagcagaaacgagctcttgtggagaaagtcactgatgctgttgttgaaacaacaggcgcaggtgcagaaaaagtctctgtcattattgaagaaatgaaaaaagaacactatgccgtagcaggaaaacgaatgagcgacctgtaagcataaaaaaaggacaagcacataggtgtttgtccttttgtctcttattttatctgtaccacgctttgttacggttcacttgatttttatgagccgcatcaaagaaatcgactgtgtaggaataatcatagttcattaggcagacaatgccgctgccttgagggtcatgcggtaagccaaagttatgaccatattcatgcgtagccgcttttgcggtgttcgctgttccttgatcaaggttaacggcgaatgcacttccgctcggtgcactattgtatacataagcgattccgcctgcatcaaagtttggatttgctgtaaatccagtgacaaaatcgtatcctctgccatcaaagctgcgctgaaggttggacagaatttgcgatgaatttgatccagaagatgtccaagatcctactgcttgtacgacaaagtccacatcatgatcacggttaaaggtcacgtccgcttgctcgatgatgctgacaattcgcgtctgccagtcactatatttcgcacgatactgtgcatctgctacagcatagaccgttactttttgactgcctgtacttgcctttgttgaaatagaatcccctgtattcgccttaaaggttctagagcccacctgcttaccagactcatctaatacctttgttgtcacatctcgttcaattggaggtgctttcgtcaaatctttaaaatcgtttgcctttggcaacccctcactaatatgtgtttcgaatggcgcatgaccatgatcatgcccatgaccagcactcgcgactggtgctgaagctgaacttactcccggtaacaaactacctaccaataaaaatgacaaaaagactgaacgctttttcattcctatccctcctttgattttcacaaagttatatattcactgaaaattcaccattttccttctattcagtcaaaaacaggaaattagatgcacgagaagaaagtcggaatatgtcatattcactaattttctgaatcgttcagtacacatttcattgaaaattagcgcttttgttccaggtcttacaaaataaaaaaagccctaaatactgggcttttgtgaaactagttcaatttcttcaattgatcaatataagcaagagcatcctcaaattcttcgtccgtatagcgctgcttgcttttaatggtgaagaccttttcctttacctcatcttctggcagatcatcaaagtataaaatcgtagagacgagctctagaaaacgtgacgactgctcgttcatctgctgcgtcagcactttgaggtcaggcatgtccacttcacactgatcgagaaactctttcccattgtccgtcagcgaatagcgatattgatagtatccgccttttttttccttcatttcgtccaagaatccaaggttgcacagctcttcaattctgagcgtcaactcctctgaataggggccataaaagtgaaaatcgtatttctcgtaaaaaggcaaatctagcttttttgctatgtaaatcatcttttgcagcttcttccgtccaacgatttccccagattcagagaataccttcatcaactttgcatgctctttcaacaaattcccgacatctcctttttcagtacttccttatcccaatccaagcagcttcatgatcgccttcttttcttcagctttttccgacatatctacaattaagtccatcgggaaataaagtttatgatcggttcttcgtttaccggaaatggcatcaacaatatctgactgtctcgacagctctttaatatgaccactttgcgtcaaaagatggatcggcagtctctcttcttcctcccctggtctgtagaagtcgtagggcaagtcagaagaagagtcgacgactaaataatagtcaggatcaatgcctgcctccttgaacaaggcggtcagcttgaaatatttcgtcatttcttcattcggattaaactctgtatattggaacaatcggcggttcataaaacggcggcacaaatcagccagcacgtgatcttcttcatcttcccacgcctgaaaataaaataagacaatggattcatccagtttaatatagtcctctgtggtgacattcccctcaaaaatcgaataaaaatgaacaggggcatgtgtgaaaatatagcccgtttcatgcagctcttttgcacgatggagaattttcgttaaaatgacttccgcactgcgtgtcactgggtggaaatagacttgccagtacatttgatagcggctcataatataatcctcgaccgcatgcatcccgctctgcttcatcacaatctgatcttctctaggacgcattacgcgcaaaatacgctccatatcaaaatggccatagctgacgcctgtatagtaggcatcacgctgcaaatagtccatacggtcggcatcaatttgacttgagatcaaactgaccacctgtttgttttgatacgttttggcaataacttctgccacatgcttcgggaaatcatcactcacccggcgaagcacttcattgacttcggtttgccctaaaataatatctcttgtaaacgattcatgatctaagtggaagaccttttcaaaggaatgagaaaatggtccatgtccgaggtcatgaagcaaggccgcactcaggacaagctcgcgttctccctcatcccattccggccgtcctttgaaaacatcatctacaatccgtctcacaatctcgtatacaccgagtgaatgattgaaacggctgtgttctgcaccatgaaacgttaagtaagtggttcctagctgtttaattcggcgcaggcgctgaaattctcttgttcctattaaatcccatattaatgcgtcccgtacgtgaacataacggtgcacaggatctttaaataccttttcctcagataatttcccttttggatacgccatcgtttcgtccctctttttttaagacgtgtttctattatatcgggtaacttttcccgaaaacatccttgaatttgctcgtgaatgtgttctcaaagattgcacggacgtaaaaagcccgacctgacagggacggacctctttttaggtcgactgaacacattcagtgacatttatttgacttttttttgaaccttttcgagtaactcatcttctgttggtgcggataatgggcgattgttcacaaacgcaaaagccttttttcgtcctggaccacaataggattgacagccgatttcaatttttgcatcagggtcaaccgatttgagtcgaggcaacaacgtctttaggttcgtcgcatcgcaatcgtcacatacgcgaaactcattagccatggtcttacgcttcctttcaatgatgaacttcattttatataaaacagttggacaaccaagagtcataatataccacccaacattgtacatcgaagcggctggacttgcaagacgcatgataatcgctgagacgcgctcatataaaagctagtattttccactatccttttagcaaacttgtataaaccttcttgaatttggctaatctaataccatcaaatcatatgggggtttaaacatgtcaaaacaaagacaagatgcttggtcagaggaagatgatcttcttttggcagaaaccgtcttacgtcacgtgagagagggcagcacacagctgaatgcgtttgaagaagtaggagacaagctaaatcgcacctcagcggcatgcggttttagatggaatgctgttgtaaggcatcaatatgaaaaagcgctagcccttgccaaaaaacaaagaaaacaacggatgcgtgctcttggcaatggccagcctgcaaagaaacgattactctatcagccgcaagtagaagaaacagtcacgcaagaggaattctcacaggagctggaaccagcgcaggaagaaacgtttgcaccagcatctgaaacagccgagcagctccagtttgtagaccaaagctacaatgaagagttagctagtttatcacatttattgtcacaggcttcacatgtcgtagagaaaaagccagaagccaatccttttaggcagcaacaggagttaaccattgaagatgtcattcgtttcttgcgccgctatgaaggcgatggacagcaatcctctgcattacgcatggaaaacagccggttaaaacaagaaaataacgaactttcacataaagtcacgcagctagaagcagaagtgaaaaagcttgagaaggatcagctcacgattcaagaagattatgaaacacttgtcaaaatcatgaaccgtgcaagaaaactagttttgtttgaagaggatgacactgccgctccaacctttaaaatggaccgaaacggcaacctcgaaaaaatggcagaataacaaaaagtgctccccatctgcgggaagcacttttttaaatgcccaaaaatagcatcacactaaaaaggacattcatcaaaaagacaaacataaaaatatacctgacttgtctcacctgaaaatcaccaaatataaaaatataaagacctgcgatgccaagtgtcaggacaggctgaagaaacggcaccaaaagcgaaatgccatagccggctcccatgataacaggaagccatagtaaatagaggtaaccgccgttttttgatttcaagaaaccactccctctctttcttctatctgcttgatttcaggttgaacaaatttgagtccgaccattgtacgtccgcgtctttttgaagtccaaacggcaatcgccggctgatctgtcagagattctgcgtcaatggtgatccgcactttctcatgtaattcaataccagcttcagactcgattttacacccagatacactaatatcatgtatgactaacggcaccttctcttctaatctgccctcatatgacaacgtgcctgtcacaccttttaaaggttttctcatccatttgcgccgtatagcctttggcactttctctgtctctcttacaaagcggagaaacgtccgaacagcataggattttttctcataatccgtaatggctacatgctctcgtgtgaataggaagcggattagtgatagatactctgatttttgtgtgtcagtaaaagcaacacctaccatcagcttgtcttcctccggatagctccagaccacgtcacacgccacacgttcatcctctgtaaagaataattgcgtttgtccttgataaagagaagatgcttgatccaatggaatggagagacgcgcacctgaatcactcatatcttgcagaaaacaagcaatcgactgatcttgatgatcagaacgaagatgcccctctttttcaatgataaatcgctctgatttccgataacgcggacggtcaaacgccacaagtagtgccatgaataggcctgtaccgttatacatcacccaaaatatattaatcaacgtgagatcagcattcatcgtcccatttaccttcacatcgtatcctattttcactaggacaagcaatgagagcagcaaaaagatcaaatggggaatcatcgttttcaaatgaaaatgtcttttgtccgtttgaatgccctttggtgtgacaagaaattcaactctctttttgaaaaacagctcacttaaagccacaccagctaggtggaacgccatagagctttcataaatatgactccagaacatgcttctcttttgattcgacacaagtttaaatgctaaataggaactaaagaacgccggcagccagaacatgaaaatagactggaaatctgcccagaaactttgaataccaaacaataaaaacaaaatcggtgtgagaatgtaaatcattttaaacaaaccgttaaaccaatacacaataccatctaaataaagaactcgctgcatcagcgttaagccgcgaaccttcaaaggattaaacttacgggcacactgaatgttccctctcgaccaccgatctctctgctttaatagatcaagccagctttcaggtgccagcccgacggctaatacttctccgacagacacagatttgaactttccttggagaagcatgcctgtcgccatgtcttctgtaatcaccccagtagcaaatccgccaatttcatctaaagctattcttctaaagacagtattactaccgacatacatcacagcattaaaccgatccttcccagcttggagggtttgcatgaagaagtcctgctcatttggaattcgatccttcgagaacatattatattggaaaggatcttcgttataaaacgcctgtggaacttgaacaaacgccgtcgctccatcatgaaagtaaggcactgttttttctaaaaataaaggaagggggaccatatccgcatcaagtgtgagaatcagctccccacttgtttgagacatcgcatggtttaagttacccgccttcgcaaacttgttatctgttcttgtcagataatgaacaccaaactcagaagcaagctgctgtacagactcccgcttgccatcatcacataaatagatgtggactttgtcctttggataagagagattcacacaacctgcaacagtgcgtttcagcacttcaattggttcattatatgtagctatgaaaatatcaactgttggcagcctgtcaagatcactgatcgtgacttgcttccgattggaaggcttccaaacaagtgtataaaacacaagcagctgtaaaaatccaatgcattcacaagcaacaagcaaaatacccatcacaatattaaaagtaccttcatgcggcagtgtaaagaaaagacgccagcaaatataggcggcatttgttaacacacagagcacaatgatgatttttttaacagtagaggccaccggttgaatacgatacatcacatacaacacagacaaaacgcaaagcataaacagcgggtaatacgtggtgaataatgacaacaaatttaccttctttcttataccataaatgactattacatataaaatttcataacaaaggaggggattttttcataacattgcccctccaattctattcaagtagccaaatcaactattatttccataacctatctaactgatttgaataaaaatcaatcgcctttcgataacttaaaatagcaggatcttttgtcgtttcagttaaacagttcagtaatatttccatcgctttgctatgttcctttaaattatacaaagtcatggcatagaacgtttgaatggctttgttgtctggataagtttccatcccttttaggaatatctgttttgacttttcatattctcccaaagttctgtatgtacttcctaaccctagtaaagcatcttctagttcttctgaagacaatcctaactcaatggccctctcataaaaaaagacagcttgcctttcctcacctaacaggtcataactccaggcacattgataatgaatagaggcatcgtctggatactcctctacaagatgagacagcaattctcttgattcttgaagatgtccactttttcgaagttcaatggctttttcaagctttgtttccatcactccacctctactcttttcaagatgaaaaggctgatgtttacgaaaacaccttttcattgcgctcaatcatccgcgtcatgtttttctcaaattccagctgttcttctgcgttcagtcctgatgctgtcagctgatcactgagcttttgaagctcctctagtaataggcgcatgagaaatgtacaatcaataatcggttcaccaattaattctgataaggatgccatcgtatccggctgtatatcaggaaatactgccttcacttcttgccgtttatcctttaaggcggcatcataaaaacggcggatcaagtcggcacgttcacgcccgcttccatctgcacacaaataaatttgcacagcgactccaccgcgtaatctacgctgagaaatgcctgcaaatttctttccattgatgcttagatcataactgcccggacaataagagccgacaatttcataggcttcaatgtccacatcatacatcgacagcatccggcggaccaattccaccatcgcatcatacccgcgatcaatatcaatgcccttcttttgttccgcaaagattaaagacacatttaagacaccttcatccagcaccacagcaagaccgcctgagttacgtacaatgacgcgatacccctcttcctcaagcagtttcacgccatcttggagaaatggaagtcttgtatcctgaatcccaagcacaattgtattgtgatgcacccaagaacgcgctgtcgctggtgagagtcccttcccgaccgacgcacaaagcgtatcatccatcgcaaaggattgctttgggtccacataaaggccgaggctcgattgatctatgattcgccatttcggctgtgtcagtaactcaataggttcatttttcatgtcctgcatatcctctcgttcataaactgtgtttattataacatgggatgaatggagggagaatcggagagagcatcaaaaaagctccatgacatttaacgtcacagagcgttcagttggatgattcagttttgcttttcaatgattcatgcatttcaatgctgtgatcattcaatgatacatccccccctcacccactccagcaagtcttcagtgaccaactctgcatgctgagggtccattacaccagcatctacaacccacacgcgtttctcttcttcggtctgacgcatgagaaatacttgccctccaccatcgtcgccaatcgctacatagccgcctgcataccgctgaacctcccacgttgcattgcgttccgtaatgtcctcagtgccgtacagtaggacatcgcctccaacggaacatccatttgtctgtttgagtaaggtcttattaacctcgggcagtaccatgtttagttgggattctgcctttttgatttgtttgtcacttgctgattcgttcaggtgattgtttgggttttgaaggaaattgatcatgtttgagagcctcctatacttttaagacttcaccttctactaataaatatctaatcgtttgcaattaaaacttataaaatcgccttcatttatatctcctggtatattgtaatccagttctaataaaagtccgcctactctcaccttttcatcacgcttatcaattaattgtcctaagaaactataactaaaatgatcatctaatttttcaattccaaactctgacaattcagctttcactaagtctgagacatctaaacaataaataggctctaatagttcatttccttcatggtaatttaatggttgagcaaaacacattatttccagttcgccatctgttacaatcacttcagcttctgaggcttcttgtgaaatccagtttatttttcttattttcaatatgatcaccctttttacttctttgtttttatacctaaacttggcgcttttttagaaagttctttaaccgattttatatgaaatgtggtaatattccctgtttttctatcaagccccacaaatccatattttgcgcttccttttccaccaataagtctcacatatccattcaattctggtacatatcgtcccttatgaataacatgatttgcatctttaaggtaattttttatattgtattggtttttacccattgcatccattatctctttactatgcttttcataatgaataatagcttgatcacctttaaatttaatcagatcatcagcacctgtagtcgtcttcttaaccctcttagctactttctcccctttaagcatcttaaaaacatatttccccactttcgcaacttttgcgccaggtatcatgtacaaccccgataccaaacgatccatatccacgactttatcacctgttactgggtctcttcctgtaatcgctcgaattgcgtcgtttattcctgtaaattcgactgctgtatttaagatgttttggggctgatcgcctattttcacatcagaaatcggtttaacgctctcaatcgttactttgtttttttctgatattcgtaaccgatacagcattccatctcttatgacttcaaccgtctttgcatgttcgaagttaatctttttgtactcatttatattgtatacttttccatttaaggttacggtggtttgattaattttactagacgacgcttctcgaaccaccgtattcacattcgcctgttctttctctctcaatttcttcagcatgatcatcattggattttcttttaggttgttgtctattttgtcattcaatccaccgatggtgctgcttattttttcttcttttccatttttgaaaatagatcctttttgataggtggtgatgtcgatttttgggccggtgaacatggtacttaaggtatgtatgtattgcttcattgtttgaagagagcttgtggtttcatgtaaagcgcttgtctgctctctgtcaaatgcatgaagcagaccaatggttcttgatgtctcaagccatgccttttgatagttttgctgaaacactgattcgtctacatttggtaaatgaacaatatgaccaactctgccaatggcgtggtttacatccgttacaatctcggatatcattcgttcagctttttttaaaccttgatcaagttcgtgttcaataaatgcttgtgatataaagccatgcccgtttgattctagtgcatgaagcgcctgctttgtgtttttcagcgcagtgctgtattcctcaatgacgacctgaaagaattgcaggaagggaatatgacattctgtataaaaggagcggatggcttgtcccgcctctccctttagtgcgccatcaagtgagatgatgtgatggatttgtttttctatggagctgatttgttgtgattgctgctttaatgtatttagcgtttggtcaattccgtttattagcgcaaaggcgtcaagggttttcattgcgttctcctttattttcttttactgctggaggcaagcgccttgtccgtttcgatcatggtgttcaccgcttgttctgtttgtacaagctgtttctgaagaatgcctatgtaggatgtacttaattcgttcaattgttgattgattttttctaatgtgtctgctgctaggagctggtttctccctttgatggatgttggaagttttgcattcatttgagcgcctgattgtttagtatgttgtaacacttgtttgatttcactggcatctattttgatttctctactcatgtgacttccctcttttttcttccagttgtttctgcttttctttctctatttttctttcaacagaatggatttcatgttctaacgaatgaatttctgattttaagtcactgattttctcatcaattcgattcactagattggtcagctgtacacctttaatctcttgactggcggatgccatctcgtctcgaatgtcatcaaacgtatctgcaagatggccaaaccatgtatgtgatgtcagatctggataagtcattttcttgttagcatctgccagagccgattttgcttcttttatttcttttcgacacatcttgagttctatgatttgttctttttttatggatatgtctgcctttaacgagtacaaggctgttgtataaccgatgatagctccagacatcgtcaaacacctctattcctcaaatagtcctccgttatgttaccatttcctagcacaagaggcatatgattgaaaacaaattcaccgaaaaatgaatcgtaggtattgggtttttatacctatttcacatgcacaaaaaaagctgaattcaccaactgaatccagcttttgacgcttatttgaccgaatcaccagctgatgctgatggttgatcgctaaatgacgtgtctttcttgtcaggaatataatgaagagagaaaccgataagactaaaaaaagcgcttaacacaagtgtgggatttttgaataggttcgtacttgctatgatcaaatctccattttgcaagagaatccctagaatttgaccgaataccagcatggtacctgacgttaagaaaaggacaagcagcactttaaataaaaattccatcaatgctctcatgtgtttctcctttctatactggaagtatgcccattccaatgagccagccaattcctacaatcggcagcatatagtaaagaatgagcggtataaatgttttctccggccgggctcctgcaagaccagaagcgatgaaaattgaccctgatgcaggcggggaagcgccttctgttgatgaaaaggcaagaatggcgacaacagcggcaactggatctactccgactgagattaaagctgaaaatgagacaagcccaacagctgttaatgtagcagttgaagataatggtccggccaccagcgtgacaagaacaccaacaatgagcaccatgagccacttcggaatggcaagtattgatgtgatgtgtgtcaaatcttctgcgagtcctaattcagcaagcacctgactagcagcaacagcaaacagcatcaaggcaccgatcgttgtaaacttaggaatggccgacttgaaaaactgagaccaatctaaagcagacgccttttttcttccaattgttaagctaatcagcatcatgagaatcggaatccacgtaattaaagaaatttgatccattgcctctggtccaatgtttggattactttttaagtagtttgccagcggaccaattgtgatcatgatagggatcaaggcaccgaaaaaaataaaaatcgatttccacccttgtttcacagcttctctaaagggaacaatatcatctggcggcatcgcttgaattttattttttctcaccagaatatacacaagaataaatcggtatacgacttgatacagtccacctattaaaagagcaatatataaatcaccttcagagacaagggctgcaactggtgcaaagccgagcatgataaacatggaagagttcggcggcagcgcggctccaagtccgccattcccagctagaatcgtggccgtatgggttcggctccatcctgatttaatcatccaagaagccgtaatagagccagtggcagctgtgtttgcagaatttgaacctgaaagagcgcctaggattgctgaacctaacgtactcatataagctgcgccaccaggaagtctcccgatgaccgaattcaggatgcgcaagagtgcctgaattaattccaacttctcgattaaataagccatgaatacaaacgcaacggctgcataaagcacctcatatgtggatgcaaatattaaaccatcccagaacagtctaagcgcatccattccgccaaacaaagtggttgcaataaagcctaacagcatggcttctcccatatttcgtttcacgatgacattccatataatgatgacggctatgaatacaatcaatgcaataaaacccatgtcgtttcttcgcctccctttcacttaataaagcgcttacaaaaatcacccttgctgcatcacatcaatgacttcttcccagctggctggtttttccccattaaaccgttcaatgaattgaaagtctgctaatctctctagcttctgttgtgctgcccgggacatgctcgcatcaatatgagctgaatccagcatttcaatagagccaagtagttcgaccgctcgtctttttgcatgtaatgcacttcctgtcacaagacgattcattgtttctacaaaacttttgctgtccatcgtttcgcttagtgaagaaatcacttgatcttctacattatattttttggaaatttccaaaaattcaataagtaaaccgacgattcctttcatataaatgcttcttattagctttaaggctgaagcatctcctggctgatcactgatttttgtaatattcataccgtattctttcgttaattcaatgaatcgatctgttccacttccgcttgccgtgattggaaccttatgtttgttaactgggagagatcctagcatggcggcatctacaaatagagcttcttgctttttaatttcgtctgccacttgttttttgatgtctggagttgatgccgacacatccacatatacttgattttttttcaaacttcctaatacagattgagccacctctaaggttttattcgctggcacagccgcaatgacaatgtcagatttctcaatgacctcactcacattacttattaattcgacgcctgtacgagctgctttttctttcattgttccagccagtttctcattttgtaataatacatcatacgcataaaaatgttctaatccttctgttttcaaccccgttgacagctcatatgccgcttctccataaccgataaagcctatcttcatcacagattcccctatccctgaaattttttcattttgccctctagccatgcaggtgctaagagactgatatcctgcttttcttcactcatataatgttgaatggtttttaatctttgattttcatatgcttgtttcccctcagccagcgacagcatctcttctgctttctccttcgggacaatcactactccatcatcatctgcaacgaccaagtcacctggtgatactttgacccctccacacgagatgatttcattcaattcaccagggccatccttaaaaggtccattcggcgtgaatcccttactatagattggaaaagctaattcctctaaagcgactttatcgcggacaagaccgtcgatcacgattccttctattccaacagcctttgctgcacctgccatcaattctcctaaatatgcgtgacccctatgatctttcccatcaacgatgagtacatcgcctacttgcgcagaataaatcgcttggtgaagaaacagattatctcctggtcgtaagctcacggtaaaagctgtgccgactacattcatgcctctcgcaactggtttgatttgatgatccatcgcgccggtgcatcccatcacgtctgacagcaaggtcgagttaagcttttttgccctagctatgagatcatttgacacgaaatgaacagtactcattgtttccatcatcccctttgagttatattcattacatttaattaatttaaagtaatatatattactttcgtgatatgatcataccacctcatttttaaatagtaaagcgctttcaaaaaaataaaaaaatgagttccacacgactaatgtgttgtgtgataactcattttcgttaacatatgattgatttgatctaaacaaggtttggttctttcaggatcatccatcgctaatgcacttaagatgaaatcgacgataaagatagccgatacgacagagttatgagagcctacacttgctgaggaacatggtaatacatattgtgcatatttggttagtggagagctgtaactgtctgtaattaaaaggacttccaccccataagacttcgctgcttccatcaaatccttcatacgctttgcatagcgcggatagctgacagctataatgaaatcacccgagttgaaatgaaccaaattatccacccagtcactttgatctgcatcaatatactggcaattccccaatagccgattgattcctaacgacatgtattcgccaacaggtcttccacttcggacacttgtacacaaaacgtggcgtgcgctagctattttcccaacaatttgttgaaaggtttcttccgtgatattgtccaatgcgtactggatattttgaaattgcagttctacatggttatgcaggagcttactcttatttgaatgcttgagattcgcttcaagtctcgtttgagggtcggctttatgcttcatagctgattggagctctttttgaaactccgaaaaaccggaataccccacagcagcagagaatcgcatgatagttgctgtactcgtcccgacttttgatgccaatttatcaacagttaaaaaagcgacctccattggatgttgtacgatataatctgcaattctcctctgtgaatcggttaaaaacgcgaccttatgctgaagcttatgtattaaatcctccattatagcacccgcccatcctatcggctttatctacgatcagatttgttctctctatattgtacacatttgtccaaaataaaaaaacagccagcacgaatatcgcgctgactgctttagccgagatgctagtttatcgtgcttgagctgctgtgataagcgcaaggttgtaaacgtcttcggcattacagcctcttgaaaggtcgtttactggttgatttaagccttgcaagattggacctacagcttcaaagttacctaagcgctgtgcaattttgtagccgatgtttcctgcttctaggctagggaaaacaaatacgctagcatcgcctttaatgacggaatctggtgcttttttcgctgctactgaaggaacgaaagctgcatcgaattggaattctccatcaagtacaagctcaggtgccttttcttttgcaatacgaactgcttcagatactttttctgtttcgtctgattttgctgagccttttgtagaaaagctaagcattgccacacgtggttcgatgtcgaacattttggctgtgttagcactttcaattgcaatttcagctagatcttggctgtctggtgcaatgttgattgcacaatcagcaaacacatattgctcttcgccgcgagccatgatgaagacgccagatgttttctttacgccttcttttgttttaatgatttgaagtgctgggcgtactgtgtcagcagttgaatgtgctgcaccgctcacaagtccgtctgcaagacctttgtacacaagcatcgtaccgaagtagttttcatctagtaatgcttttcttgcttgctcttcggttgctttgcctttacgtctttctacgaaagcttgtacaagctcttcaaaaccttcatatgtatgaggatcatacacgtcaacaccatcaagtgtaagacctaattcttttgcttttgcttcaacttcttgtgttttacctacaacaattggctgcaagacttttccatctgctagtttttgaacggctgttagaatgcgttcgtccattccctcaggaaaaacgatctttactcctttacctgcaaccttttcctgaactgttgaaaaaatatctgccacttatataccctccttgattttacaaaaaaagcgttctcttttaagcatactcttcttctacataaattcaaactaccaacttacattatagcgcttacatattaaattcttatttttcaaactaattaaatcaatttccataaagctgacttcgtcgttcaagttttgatcacatcttcatttggacaaactatgttatagttggaacagatggaaaactgttaataggagtgaaagaaatgagcgaacaacatacaaccaatgaagcagctcaaacactagacggctggtatgcactgcatgattttagaacctttgactggacagcttggaagctgctgacaagtgatgagcgccaagcgattcttcatgaattcacaggtctattagaaaaatggaaaacagctgagcacgataaggctggaagccaaacaatctatagtattgtcggccaaaaagcagatattatgctcatgattttgcgtccaaccatggaagaactgggtgaaattgaacttgaattcaataaaacacgactagcagagtttacgatcccagcttattcgtacgtttcagttgttgaactcagcaactacttagcaggaggcggagatggcggagatccttacgagaacccgcatgtacgtgcacgtctatacccagagctccctgcttctcaatacgtatgcttctatccaatggataaaagacgttccggcaacgacaactggtacatgctctctatggatgagcgtaaatctcttatgagaagccacggcttaattggccgcagttatgccggaaaagtaaagcagatcattacaggctccgtcggttttgatgattatgagtggggcgtcactcttttctctgacgatgtgcttcaattcaaaaaattggtttatgaaatgcgctttgatgaagtcagtgcacgctacggcgaatttggttccttctttgtcggaaaccgcttagcaaacgagcagctggcgtcttattttcatgtatgataaactcttaaggcttcggatctttccgaagcctttttatgtatttttttagaaaggtgatcacatcatgaaaaacttccccatcgctatttttgctttaacgctcggtgcgttttcgattggtatgactgaatttgtcattatgggacttttgccaaacgtagctaacgaccttcatgtatctatctctgcttcagggcagctgattactggatatgcacttggtgtggcagttggcggacctattttaacgttatcgactggaaaaatgtcgaggaaacgtcttctcattttattaatgatcctgttcgtggggggaaatgctgttgctgctgtatcaacctcttatggcctattaatggttgcacgtattttgacatcatttgctcacgggaccttctttggcgtcggagcgatcatggcggcacggcttgtgcctaaggagaaaagtgcaagtgcgatcagcttcatgtttacaggactgacgatcgccaacgtactgggtgtgccgttcggtaccttcattggaaatcaattcggctggcgtatgtcgtttctcgtcattgctgtcattgggctcatttccttaatcggtatcatcagcttagtacccaatcaatcgaaggaagaagtactggatattcgaaatgaagtgtctgttttgaaaaagccacaagtactcgtctcctttgcaatgacgatctttggttttgcaggtgtgtttaccgcctttacgtatatcagcccgatcctgctgcaagtgactggttttcaagagaatggggtgacgctcatccttgttctcttcggacttggggtcaccatcgggaatttagttggcggaaagcttgccgactggaagctgatgccgagtattatcgtgtccttgatcctgctgatggctgtcctgttattgtttactatcacttccgaattcaaagtgcctgctgtgctgaccatttttgtgtggggaatcatttcatttattcttgttcctaccttgcaataccgcacgatgaacatggcacatgaagcaccgacactcgcatcaacgctcagccattctgcctttaatatcgggaatgccggcggtgctgcgctgggcggccttgccatccagcttacacatttacagcttgtaccgttatttgctgcagctgtaactttcattggactcatcattacgatcatgagctatcagtcagacagacgaacaaaaaggacctgagtcaggtccttttttatttcatcacggtcatttctggctcttctatttgtttcacacgttcctgaattgggtgggaaaaggagtgttcggataagacgatatgagatacggtttttgtaaacccagacactgcctgaataaaggcttcaatttcttcaagggaagcgactgacaacttaatgaaaaagcatgactgtcctgccactcgatacgcaaaaaaagcgcgtgggtgctgattcataaaagccacaaaacgctgatactccccatttagcactgtgacttccagtaagcagtcaatcataagccctaattttttatagttgacctgaaccgaatacccttcgataacccctgcatcctctaatttacgcactctttctgctaccgcaggggcggataaattgactcgtttggacaactccctcatagataagcgagcatcttttttcaattcatttaaaatatgcacatcaacatcggtgattttcattcgtacctctcctatccaaaaatcgttccatttgaaaagtattttatgataatacttatgatgcgaaatgtaaaataaaactaaataatggtagaatttattttaacggaattgaatgaaaaagcaagtatggagggatcacctgatgaaagaatctttagacagccaggcttctaaaacatttcccatcacacttgccatcgcgctgacacttggcgtctttgcggcgggatcggaagaactggtgatttcaccactgctgcctgatttatcaaactcctttcagcactctcttgatattctcgccctttccatcagcatttatgggttagcagtgcttattggagccccgctgcttgttcctttaggggaccggtattcaagggagctatgtctgatcatcgggctttctttctttttgattgggaccgtgatgtgtgcggctgccccgaatttggcggtgttttttgccggccgtgctatttctgggctggcgaccggtgtatttgtgccaacagcctatgcgcttgtaggcgaccgggttccttatgaatatcgtggcaaagtgatggggctcattgtgtcgagctggtctctttctcttgtcctcggtgtaccaattggcgccttcatcggtcagagtttaaactggcgatggaccttttggattttcgccatcatgagtctcattgtcctgctgctcgtcattattgaatctcgtaaacaaaccgccacagcgaatacaggaacacctcaaactagggagaaagctggctctttatggggagctttgaaaattgatcgtgtccccgcctatttgaccgtgactttttgtaatatgctaggattttatggcatgtactcgtttttaggagcgtatctgcaaagtttgttttctggagggcaatcgactgcaggactactgatcatggcttacggcgtcggcttttccatgagtgtatttacagggaaattagcagactggtttggcaaaactcgttctcttttctttgtgctgggcggcattacgctcgttctcgccttacttccttatgctcctttctcctggacattgctgatttttgccctatttatttggggtgccatgcaaagtttatccgtcacgcttttgagcactattctaagtgactgctcccaaacccaccgaggaaaagtgatggctttttacagtcttgcgtccaactttgccgttatgcttggttccgctcttatgggacctgtctatgtccatttcggctatcatacggtagggcttctatgtgctctcattacgctcgttggttttcttgttagtttcgccagctataaacgtgaacgaaccttacagcagaaacataaaaacacatttgaaacgtaagctccattcactgcacatctaggtatgtgcagttttttagatcaatttttaatatcatcataaaatacattttttataaattttgttgacaatttacaaatatattttttataatctagtaaaaatttgaaaaagattggatggtaaacatgatcttaaagaatgatgtttttcatttcaaagaagagcccatcgtttcacctaagatgtttacagtcaatacactaggccctaaggggacaagcagtgaatacgcagcaaaacatttcatctctcattccaccactacactcggcactcatacgaaactatccctttacgacacgttcgaaacttgcattgaacatactctctctcacgcactccaatacactctcgttccacacgcatacgaaggaatcaaacacttctacatgagacctgacctgcagctcttacaaattttcagatgtgacacacccatgtatggtttggctgtcagaccagattttccatttcatgaacaaatgctccaccatttaaaaattgtctctcatcctgcacctgtcaatttaattcaatatttcattcaccaaaatgctgaatttgagctggtcaattcaacaagtactgccgcacaaaaagtaagagacggcgaatttgatttcgctttaaccaatgaggtagccagagccacatatggcctcaccttcgttcgaacgtttaaaagcatccctatgagctggtccatattcggaaaaggagagatataatatgcaaactgaacaaaagacgcaagaacgatattttccacaagccaaaaaaatagaatgggagaatggtgtcacacaatattccacggtcagaggtgatacggaagtgttaatctcatacgtccctcctcacacgatcattgaacctcacgagcatcccgaagcacaaatcggcatcgtattaaaaggtgagcttcaaatgacagtcggtccatcaatccaattactcacccctttagaatcagcctatatcgcaccaccttttgtccctcacggcgcttctaacctgacagatgaagaagtgattgctattgatattaagagattaaaagatggcgaggaatatacggcgcctcctacttatttcttagacattttcaaaacacgggatttactccctggcatggaagtgaccttttttgttgaggactggatggagctcatgattgccaacattcctggaaatggcggagaaatgccttttcataaacaccgcaatgaacaaatcggcatttgcatcagcggaggttatgatatgaccattgaaggctttacagagaaaatggaatttggtactacctacttctgtgaacctaaggaagaccacggggcgataaatccaaagccggaagcctcaaagtctattaatctcttcttccctccccgctataatcggttgaagccaaaagcgtctaaggtgaagaaatgaaccttaccggaaaagtcgtcttgattacaggaggtgcatcggggattgggcttgccgcagtcaagcttttccttgagcacggagcaaaagtcgcagtggctgacatcaatgaaaaaggcggaaaacaactcgtcgaatcattggcgcacgagcatcttgcgtttttcaaaacagatattacgaatgagtctgactgtcaaataaccgttcagtctgtgctgaaccagtttgggacaatcgatgtgctgattaacaatgcaggcattgaaattgtctctcccgttcacgagatgacactggaggattggaatcaaattgtgcaggtcaacctgacgggtgtatttctcatgagtaagcatgctttgccgcatatgcttgagaagaaaagcggaagtattattaataccggatctgtcggagggcttgtcggctggcctgacattcctgcctataatgcaacaaagggcggtgtcattcagctgaccaaatcgatggcggtcgactatgccgcccatcaaatcagggtaaactgtatcgccccaggcattattgatacgccattaaatgaaaaatcctttttagacaatcattcagaaagtcttgaggttgttaaaaaggaaaaagcaaaggtgaatccattacttcgtctcggaaaacccgaagaaattgcgggcgtcatgctgtttctcgcctctgatctatccagctatatgactggaagtgttgtcacagcagatggcggttacaccgctagataaaaaggagtgctttcattgagtaaaaaaaccgttcttgtcattgctgatctgggaggatgcccgccccatatgttttatgaaagcgtggctgcatcgtatcatatcatttcttatatcccgagaccctttgcgattacaaagggacacgctgaactaatcgaaaaatactctattgcggtcatcaaagatcgagattattttgatacaaacccttcttttgaacacccagattcgatttactgggcacatgatgattatctgaaatcagaagaagaggtggtggatgacctcgttcgcgtcgcttcctttttcaaagcggatgcgatcaccaccaataatgaattattcattgcaccaatggcaaaagccgctgagcgacttgggctgcgcggcgctggggtaaaggcagctgaattagcgcgtgataaaagccaaatgagggctgcattcaacgcggctgggatcaaagcagtaaaaactcagcctgtcacgactttagctgattttcaacaagccattgagcatatcgggacaccgattattttaaagcctacatatttagcaagctccattggcgtgaccctttttcatgaccgagccggcagtgatgatctctttttacacgtacaatcctatttgcaaaccattcccgttccaaacgctgtgacgtatgaagcaccctttgtcgctgaaacatacttggagggcacttatgaggattggtatcaagacgacggctattctgattatgtcagtgtagaaggattagttgttgagggtgaatatatcccttttgtcattcatgataagacccctcaaatcggctttacagaaacggctcatatcactccgtcgatcctagacaatgaagctcagcacatcatcattgaggcagcaaaaaaggcaaatgaggggttaggactcgaaaactgtgccactcatacagagatcaagctgatgaaacatcgggaaactggactgatcgaatcagcagctagatttgctggctggaatatgattccgaatatcaaaaaggtctttggggtagatatggccaagctgctgattgatgtattggtcgatggaaaaaaagctgatttgccaaaaaaactactttctggacatacgcattatgtagcagactgtcatttataccctcagcatttcaaagagagcgggcacattccgcctgaggccgcacacatcaccattgatcatgtgcatattccgcaggatactttagttggagatactgtcatcatcagcgaatccgtcccacctaaaggaacctttgtagatttatctttatttgaagcatttaatggcatcgtgtctcttgaattaaaagggtcgtcttctcaagatgttgccgcctccatccgcaacattcaaaagcaggcatccattcagttaatggatgaattagtgaagggataagaaagagaggatgtcgtggtgaaaatcttaccttctaacatgattgaacggctgccagaacaaaaattcggaaccgtatttgagaaaattgcgcataaaacaaaacacggagcgaacatcattaaccttggtcagggaaatcccgatcttcctactcctgcgcatattgtgagtgcccttcaagaagcagcaggcactttgcaatttcagcaatatgcaccttttagaggctttgactttttcaagcaagccattgcggatttctacagaaaggaattcgccattgaggttgacccgaagaaggaaattgcccttttcaatggaggaaaaacaggcctttatgtgatgagtcagtgcctgcttgatccagaggacattgccctcgtccccgatcctggatacccagaatatcattcaggtatcttgatggcagatgcaaagccatactgcatccggctagaagaggaaaatggctatttgccgaatttctcatcaattgatccagacgtgttaaaaaaggcaaaggtccttttcttaaattatccgaataacccaacaggtgctgtagcaaatgaggctttttttgaagaggctgcggcatttgcctctactcacggacttcatgtgattcatgattttgcttatggttcatttcattatgagcaaaaaccagtgagctttctaaaggctcctcttggaaaaaacgtaggcgtggaattatattctttatccaaaacattcaatatggcaggatggagagtcgcttttgctgtaggcaatgaggacatcattcatgccattaacgcattccaagatcatgtgtttgtcagtatgtatggtggatttcagcatgccgccaccgtcgctttacaaagtgatgactgtcatattcaatctttgaaagaggtctaccttgaacgaataaatttcttcatccgtcaagcggagaagcagcttggctggaccattgaacgtccagccggcgccttttatttgtgggcatcgatccctgatgatttcgaagattctcatgcatttgccgactatttactcgagcatgcagatgtcgtcgtgacgcctgggggggtgtttggaacacacggaagacgtcatgtccgcatctcaatggtgacgccaattgaacagcttgccctttttatcgatcggctgcatatactgccgattcggtttcatcaaaaaacccgcatatagcgggtttttcatatctatatacttttcatcgaaccaccatcgacagatatttgctgtccagtgacataggaggcttcctctgatgtgataaatgccgccaatgaagccatttcactcgctgaacctactctttgcatcgggattgctgacgcaacagcctgtacagcttcttcgcgtgataatgactgctcacgcatcatgttttcgataaattgttcataccgatctgtagcaataaatcctgggtttaaacaattcactgtgatcccagaaggcgcaagctgtgtggctgcatttttactagcattgatgatcgctgcattcatcatactgttcgtaaacatttgatgaccaggttccttccaaaggttcccgacaatttgaatgattcggccatattcatgccttttcatcattgctgccgcgcgtttcatcatatcaatatacgcaagagctttctgagaaaatgctgccagcatctgctcgctttcacatgaatcaaaagtatctggcttccctcctggaatgttgttaatcaacacatccagtctgccaaactctttatctattgccgaaaaggcctcagctcgcactccttcatgcgacatatcgccacagaaaagagacaccggttcctttgtttctgccatacgttcaatgtgctgccgcgcatcttctagtgaggattgatttctagaattgatgatgacctttatatgatcctgggcggcaagctttatggcgattgcctttccaatccctgtacttgcccctgttacaaatgcaattcttttagacaaactcatccacatcccttttctgcttaacttaaaaaaatacataaaatgacacttagaatgtatttcaacaaaaaaagacctttctcctgcgaaaggcctctgttctttatttaaaagtcgtttcccaatcaaatccgattgtctcgtcattccatgcaattctcttttcatctgggtttttcgggtcataggattctgtcgtgaaatagacaatttgcagaggtgtctcgcctagtacccggtagccatgtgcgacaccctttgggatgaggaggagcattggattgtcttcccccatataatacacatcagtttgaccctttgtaggagaaccctcacgcaaatcgtataaaacgacctgagcatgacctgctgggaaaaaccaaacgtcatcttgcttttcatgataatgaaaggctttgattactcctggaaagcttttcgaccacgatgcctgcccaaaacgttgcagcatcggctcatcatctcgaatgagctctgcaaaaaagccgcgatcatcacaatgtttcatgagttttttcgtttgtacaccatcaatcatgctgatgccatctcccttctttctgcaaatattcgtgaagcgcatccttccaatgtctcggctgccagcctgtggcttcaatggcttgaaggtctaacacagaataggctggacgaggcgtttggaagccgtactcttccgtggaaattggctcaatggtcgtagaaaggccgctttttgccacaatttctgacgcaaagtcaaaccaagaacagctttctcggttactgacgtgataaattcctgcatgctgatcaaacaaatgaatgatggcctctgcgacatcctttgtataagtcggtgagcctacttggtcattcacgatgcgcaaatgatcctttgtttctgcgagccgaaggatggtattcacaaaattatgtccctcatgaccgtatagccacgatgtacggatgattttcacttcgtctgatacaagatggatcaattcctcaccaagctttttactttttccataaatggtttgaggatctgcttgtgcatccacttggtaaggcgtgtctgcttgcccgtcaaacacataatctgtactgacatgtaacacatcagcccctacgttctttgcctccagcgctgtatagtaggcgccaatgccattaataagatacgccttttccgtttctgtttcacactgatctactgaggtatatgctgctgcactgacaacaatattaggacgaaagtgtctcatcgcatgtttgactgcttgctggtctgcgatattgagcatgctcctcgttaaggcaatgacggtgatgtctttctccttaagctgtatgctcaattccttccctagttgcccgcctgcaccggtgattaaaactttcatccgtcacccttcttcgctctgatcatatttggcacgataccaattgatcgttttttcaatacctgcttcaaatgacgtctcctgcgtccagccaagctcccgttttagcttactggcgtcaatcgcataccgccggtcatgtcctttacggtcttcaacaaacgcaatacggtcatgactcatcccgagctgcgtcagaatggttttggtcaaatcgagattcgttttctcgttgccaccgccgatattgtacacctgcccagctgttccgttttcaaggacctgctttacagctcttgcatgatcctctacatacagccaatcgcgaatctgctggccatctccataaatcgggattttttctccattgattgcttttctaataatcgtcggtattaatttctcttcgtgctgatgcggtccgtagttgttgctgcatcgtgtgatcattgcgggtaattggtgagtgtggatataagattttacaagcaggtctgagcttgccttgcttgctgaataaggattattcggtgaaagcggtgtttgttctgtgaaagctggatcattcagttccaaatctccatatacttcgtctgttgaaatatgaatcagttttttcgccttgccctttaaaactgcctccagcatacgataggtaccgaggacatttgtttgaataaagggctctgccgattcaatactgcgatcaacatgggattctgctgcaaaatgaatgatcgcatcatagacttcatcaaacgcttgatccagctcatgttgaagggtgatatccccttgaataaaacgaaaatgagacagctttaataattcatccatctcctctggatgactggcatatgttaacttgtcaaaaacagtgagccggacatctgtttcctgaagcagcagtttcacaaaattcagtccaataaatcccgctccgcctgtaattaaataagacttcgtcattcgtatccctcttttttcttcatcgtttcaaacattttcgtcgatgcttggtggagagattcatgtgttcctgcatcaatccaccacccttttaacatatcataggtcagctggctatttgagatatagagattgtttacatctgtaatctctaattcgcctcgatctgatggcgagattttctcaatatattgaaagacttcttgatcataaaaatagatacccgtgacgcagtaggatgaacgtggatgctccggtttttcctcaattgataatattcgttggtgggcggcatcaatttctgcaatgccaaaccgctttggatctgtcacttctttcaacagaaccttcgcaccgctttcttgctgctgaaaggcttcaacaaaaggagttagcgaatcctcaaatacattatcaccaagcattagcacaaacttttccctttctacaaagggctttgcgtaggataagccgtctgaaattccagaagcttcaggctgtacctgatacacgatgttcatccccagttcctcatcgccttcaagcaacttttgaaacagcgggatttgttctgcttgtgatatgaccattacttctaaaatccccgcttctttcaatttgaacaatgaccaataaatcatcggatatgggccaaccggcaataaatgtttattgaaaatcttcgttaaaggtgctagtcgtgatccctttcctcctgctaaaataactcccttcacatctacacatccttatgttctttttggtgatgattcatgaggtatataagaatgtttttcactcgttcggttccttttccatcaatgagtgaccgtccattgagatgaatgctcctgcgaagaaagtagctgccggacagtcttcgcacagcacgccatatatccttttcatccacaaggctacccaatccaagatggtgacaggctcccttttgtgcaaaacgagtggctgttactgcttggtggtctacttgtgaaaggacaatgctgggcaccccgatacaaacggcctcatataacgtcatcccgccagcaacaatcgctagatcagcttcggcaagatgggcaggtaattgatccgtatggcgaatgaattgaatatgtgcagcctcgattttttcttcgatgcgagaggcttttcctgtaaccgctagaatgtgtaaatgactggcttcgagaagtgctgatacagcttttgttaataatccgcctggatcacttcccccaaggctgatcaccaccttcttacattctttgcgaacctcatatgtgtcttttaatttgctgatctcgtgatctaacaataaataaggtgttccataaaagtagtccgttccatttacttgcaggtgcttttcatccagtccaccataaatgccgtttatgacagcatcagcaagctggcaagcttctgctctttcttcttcaaataagaccagttttgcatttctgaaggacgctttgatcgattgaaggaactgaaggtcacaatcaaggacatcgatcagcagaagatcaggatttagctcttttatgtcctgctccatttgaagaaatacgtttgattccggcaccaaatgaacgtgccatgctgaatgcgagagcatttctacacaaatctgttcatttgtatagaaatataagtcgtttccttcttgaatcagttcctttgccagacgcttcattctaacgacatgccccatgcctctcaaaaaaccaccgtacacaacaatcatgatttttttgttcattcagcatccttctgtctcacaaattgattcaaccgaaccatattaggatcttgttcacaaatggtgatgagttcagctgtaggcactgcaatagacccgccggctttttcaagtacacgggtggcaaatacgtaatcttcttctgtatcaaccgtgaatcgataagcaggatatgcgagttctttgggcggtgtgaataattgcagatgaaattgctcagggtgctttcggatatacagcgtgacatgctcacgctccggctgagtaaggggaaaattgtcgatttcacataaaatagttgcgttgatcatttccccggaaataccgagtggtgttccagtcgtatacgtgtaatcagccttcttctttctatgttcttcaagcattttcgacaaaagcgctggatctataaatggattatctcccgttaaacgcacaatggtttgtggttcaaaatgttgagctatctttgcgaatcgctgcaatacatccatctcactgccacgaaataccttatagccctttgataaacaataatgagccaatagatcatcttctgcttcgactgttgtggcgatcatgaggttctgcgtcttgtgattgtaatgatttgattgctttacacgttcaacaatgaaatcgatcaatgccataccaccgatcggcttcatcaccttttttggcagtcttgttgagcccattctagcctgtatgacaaagagcacatcattgatcatttgtagactcctgcatgagcacatctttccacgaaacccctgtatgggctggaatgtctctgacagccttggcaccaattaaagtctccatgtaccgcggatggagaccttggcttttttgtcctggacgtaatacggctagattttcttcggtcaaagtctcgccctttgcaatcccttttatcgtaaaaatccctcgatacgcaaattcacgaatctgcccttcaatggcagttgtcgttttaaaagaactgccaaggagctcctctgacacagaatgagcgtctgtttctgattgatttcggtccttttccgccgctcgaatatactgaaccatttcctttaattcttcgggatcgagcgcaaaggaatgatcggcgccaggcagcgtcttatcaatcgtaaaatgcttttcaatcatggctgccccaagtttcacagcggcaacaggggcttcagtaggatgctcactatgatcggaaaagccgatgactgcctcaggaaaagcggaggctaaggtttggatcacacgaagattcgtgtaagctctgggcgccggatactttgcgacgcaatgcatgatggcgacctgatcgttttgctcgcttgtaatcgcctcatatgcttcatgaacatctgcaatagtggccccggcagttgagaaaatgatgggcttttgaaaagaagctgtatgtcgcaaaagaggcaaatgattgatttcataggatgctagtttgaaagctggcggatcggtttgatttaataaatccgcagattcctcgtcacacaccgtgcttaaaaatatcagccctttttccttacagcgggttaataacaccggcagccattctggcggcagctccatttgttcgactaaggaaaaaatggacacctcttctcccttggctgtttcgtataaacctggttccttttgatacatccgatcagcttgaaacatttgaaacttcactgcatcggcacctgcttcttttgccacatcaattaaagcaagcgcctgatccagctttccatcatggttaatgcccgcctctgcaatgataaagacaggcgcaccatcccccactttgcgatctccaatgtagaaatgcgccatcttacctctctccttttttcggccatacatggtaatacaaaaaggcattttttgttctaaagcccagcttttcgtacagctgaatggcggttgtgttatgcatctgagttcctgcagacataaaccgatgccctctctcataagaggctttcaccatcgcaatcaccagcttttttccgagcccttttccttgtgcatccggtctaatggcgagtaaatcaagcaccagttcatcgtccttgatcaccccttggatcaaaccaacgacttcatcattcacctttgccgcgatattgatatctgcacgtccgagcaaattatttttcatccattcttgaaagaaatgctggacagcactctggtctaaaaaaggatcaagcgcatacctgcttttcacaaaagcctgataagcgagtgacaccgcctcatcgtattccttttcattcggcagactgatgaccacatcttcacctgttgatggcatttccatgtgaacaggcggcgcttcaagacgagtaagaccgcccacatagtacacatgtgacagcctttggacgatgcggtttttttcaatatccgccgcttcaagacgtaaaaagaaaaaatcgcatttttctgatctcatccaattgataaagcgctccattaattcctgaaaagcagatgctgactcagcttctgcaaacttcacatgaaaaatatgctgattaaatatgccgctttcccattttgaccagtcgtataacagcaccgctttgagctgggcgccactgacaagaccaaactgtttgaagcctttcatttgttcaatttgttgaccataattctcaagccaagcggacagcacctgatcgtctattgcatgaacagccttcatgaagatgccttctgttcttttaaaataaacagcaccgcagtgatgacatcctgcacatcttcatctgtcatactggggtaaagggggagtgagagggtccgcttgtagtacgcgagtgattcaggaaaatcctctggtgaatagtggtaggtttgttgatagtatggatgcatatgaacagggataaagtgaacactcgtgccgatcttatagtctttttgcagctgatcaattagctcatcgcgtgtgatgaatgcttctttcgggtccacttgcagtacatataaatgccatgcatgtcttccctcatgatgcactggcggcagaattagccctgcttccttttgaaatgcctgattgtatgctttcgcaatgtgttctctccgtgcctgcatatcatctagacggcttagctggacaagccctaacgatgcctgcacatcaaacatgttcattttatagccaggttcctcgacctcgtagtaccacgttcctttttctccataacgattccatgctcctttgctcatcccatggagtgctagtcttctgatccgagcggcaagtgcatcatcatttgtcgtcagcatgccaccttccccggtcgctatatttttcgtcgcataaaaactaaaggcagtcgcatcaccaatcgctccaatcggctgcccgtgatacgtcgtatgcagagcatgagcggcatcctcgagcacaaatagatcgtactttttggcaatggctaaaatccggtccatatcgcacgattgaccagcaaaatgaacagggacaatcgcttttgtgtgtggtgtaatcgccgcttctagtctctctgcatcgaggttgagtgtcgctgggtcaatatcgacaaatacaggagctgcccctgcatgaatgatcgtattggctgttgcgcaaaatgtcagaggcgttgtaatcacctcatccccattcccaatccctctagcttttaaggctaaaaataaagcagccgtacatgaattgacagcgatcgcatgttttgcaccggtcagctgtcgaaactcttcttcaaactgtctgacttttggcccggttgacagccagcctgattttaatgttccaatgacttcgtcaatttcttcctgctcaatcaacggcagggcataaggaagaaattgttctctctttttttccatatcgcttgcacacccctatcttcatctctgaaaatctacacctgtttttgttttaagcagagaaagcagaacatcggtcgatcgcgcatgcggataatgttgtttaatgaacttagctccttgctgctttgccagcttcatctcttgatcatccgacaaaatacgaatggctttctcagccagttcaacagggttttccatctgatagctgccaagcgactcgtaataagggtatcttctgccttctgtcattttcccgatcagcacactcttttcaaagagcatcgcttcaagaccgacggttgatgtgagcgtaatgaccatatccatatatggcaataggtcatacaagtcgatttcttttttaatcaatctcacatgatttcctgctcgttcaatggacatatactcatttaatcggttgcgggcaatttcccaaggatgcggcttcatgatcaactgaatgtccttccgttttgcaatcgtttgaagcacatcaccatagaaagcttctgaaaacggctgcgtcgccacaagtacggtctttttggcaggattgaagttcaatttacgaaagatgagttcctgctgaagcggcgttcgatccttcaccaaatcaaacctcggatgacctgtgatctccacctgttccggctgacagcctttgtctacataccagtctttttcatactttccaaacaccccgtggcacgtcgtgaaaatcggtaaaaaggcttcgtctcccatcagtgcgccgtgctgaagacagatactcgtgagctggcgtttcacagtttgcagtgcaagtacccggctgtatgcatcctccgttgtccccacaatgatagctgcaattggctccatctgaaaaagcacttctgtctggtctatcacatcaataaattgcacaatgtccttccgaagcttttctctaaaaaagacattgccaaagaccgggtgctttgcgtaaggtttaaggagagcatttgctttctcaatatattcagcatgggcttctttattaacctctccagctaattcaggcttgctgatgacaggtaaaccgaaatagtctgccttcttccagcgagcaagcaccacggtttgactcggatggaaccgcgtgtaattttgttcagtaaaacgcagatgttcaaagtgaagcaagacctttccattcgccggacgatacgcaatacgcttgatctgttgcttatgttgatcaaaaaatggctgaatctcttctggcagcggacaatcggttgtcaattcttgaccgaatgcttcatcctccatacgttcccttacctcaggactgatatattgatagaaattgctgatcaacccaagaggaatttgttgataggacaaatccttcatgagatttacaaactcaaagtacacctgccaataatgatgaatatagtgcgacacttaaggtcacctcccatgtttttgttttaatatgcggcggagctcccagcaggtagactgctcaggaagtgcttgaataaaggcatttttctcttcttccgccaactgatagtgaatggactgttctgtgatgtaatttgtatctaacacttcatcatagggatagaacggataaaaatgatttaatcgaaaaaagaaacgggcatcccctattcgataaaaatgcggactctcgtcccagtaagacccaaattcagcatgaatttttgttaaaatcgaagcacgatgaacgactgagcaatgatctatggcacaaggtgcattccattgcaccgtttgcgcaggtcgaatcgtttcctttactggctctttttcactatttaaatagattacttttgaagcagaatagacaatatcttcacctggtcgagcatctagataatgtgtgagcttctctaaacggtccggggcatagacattgtcatctgtggcataggaaatatactctccctttgctagttctaatgcttgattaatgaggacggcgtatctggttttcgctgttctctcctccagcgatttgacaccgctttggataaaatgaacacggggatcattgcgaaagggctcaatcgcggcaagggttttttcgtttgaaccatcgtccataataaatagttcaaaatctgacagcgtctgctgcaaaaccgcttcaatcgatctgccgacgtaagccgccttgttgtagctcgtcataatgacagttacttttgtcaaagttttcacctcggtctctttcaaactatgtttatcatatgtgtctcctcttaaagagactgtagagtgacctattttttataaaattgtatttttttattgttttatctttgaaaaacgtgaactttttggtaatataagtaatcatttgtgtgtattaaaggagtaaagaacattggaagctatgaagaatgatcactcccaagaagaggaagcaaaaggtttttttcgttttttcaaaattttcgtcgcaacaaaaacaattattcgctcatatcaacattcctctattcccatttggctgatgatgctccttgcaagtatcgctggtacaggctgggtctacgaagggtattttagcgattatatgggcaatcatattccattcccttttattctgttacaaggtgcgggatatggtattctagcaggcaatctcggtctatttttcggtgtactcatcctaaagtggttagggcgtctttttttcggcagtcaaacggcatatcgagatgtactcaaagccttcacgctgacgacctttttcccttccgctttatttgcactcagttggattttcacgattggaatgcttggtccgtatacgtttgtcaaaatctcaccctatttagatcagcattatgaggtttggtattatctcgatcttttgacactgattgaggcttatgcaaagacgtggatatttggaatgactgttttaggtattgtcgctgtgatgaagctcagattatggcaagcctttctcattgtgatcacaccgctggcggcatgttttctcatcgtgacactttcatttgatgtccagcgcgctgtaaattggatgatgtaaggaaggttgcacatcatattcgtaagcagcgaagcgcagaactggcaaagaatgcggggttagcccgcgcctaaggaactgcaccgcagttcctttttttcgttcaatgtacatattctgccctcctgtctcatagtgtgaaagagagaaagaatgctatggaaacaacaggtgcttaagtgccttctgtttagaacaccatgaggaaagaggaggaacgttatgaaattgaaaaatcaatttgggcaaggttcgggtttcgaaggtcaagattttcgccagcaacaatatggagcaaatccgtatcctgcgcagcagatgggttattcagtccctccccaaacgcagggtcaaatgcaaggacaaatgcagcagggattttcaccaatgccgtctactggttcttcacaaggggggcagggcatgcagagcagcgggcagccttatcaaattccttctggaccgatttatcagcagaatgtcactggtcagctgccaatcgagcagtcctatattgaaaatattttacgtttgaaccgtggcaaggtagccacgatttatatgacgtttgaagcaagtaaggaatggaactcgaagattttcagaggtgtcattgaagctgcaggacgtgaccacattatcattagtgataacaagacaggaacacgatacttactattaacgatctatcttgattacattacgtttgatggggaaattcaatacgactatccatactccatgtccacgtattctccgaggtagacaatgtcacatatcgcaaaagcaaggagcaggcgcccttgcttttttcttttgactaggtttttgtcacacctctcaggcgctgctcataagatgcctagtagtttttatcaaacacctagaggtgacattcatgactgttgagctggattatacatcaccaaatgttaaatattcatacgatctaaatcaaagcccacttgtgaaatacgatcagcataacctgattaacgttttaggaaaaaagcaattaaactcgttggatcaagtatccctgctggatatatatttgagtaaaagcaaagtcgtagagcctcattatcatcaaaatgccgcagagcttgtttattgtatagccggttctgctgccgtctcaatgctgaatccatttacaaaaaaactgcacacctataccatcacccctggacaggtagcaaacgtacctcaaggctggtggcactacgaagttgcccttcaagacaggactcatttgttagccgtttttaacgcatctacgccagaagtgatcctgggctcagaccttctcaccctcacccctgctcacatcatggcacatacgtattgcatgaacgaaacacagtggaaacaggcgattcaacctgtgaagccaagtgtgtttatcgcgccattttgccacagagaagaggaagcacaaacgaaccctgtcccaccgtctcactacatcccttattatcaagcaccgccaaactacgccccttactggaattaagaaaaaaaccgatgcccctctcagagcatcggttttttggcttataaattttttgctgctgcaatgacaagcatgatccaagaagcgataaatgccaatccgccaattggggtaatggcacctagaatcttcacctgagtcaatgccagaacataaaggcttcctgagaagaaaaggatgcctgcaagcattacccagccagcggtcggaactagagaaacacctgacagcttatctgcaagaaaagcgacaataaatagtcctatcgcatggaacatttgatattgaacccctttgttccaaatctctatatacttttcaggaattttcccttcaagaccgtgcgcaccgaaggctccgagtccaacagctagcatcgcattaatcgcacctaaaatgaaaaatagtttcattcgtcattctccttatctcgtcaattatgtttatcatagcgcgtgtgacagacgatattcaactttccgtttacgttgacacgagattgtcggatttctttttctttcgtaacagaacttgatcgaccgcgatcgcaatgagtgtacctagtacaagtccattgcttaataatgaaataagcacaggatgcatgcctttcaaggctccctgcggtacaaacatcgcccctacacctgctaaaacggcaattcctaggacaaagcgaatacgcggaatttcttcttgctcatactgatcgaactcagacatcgcaataccaatcattgaggagaataccacaaagtttacagcaagccccacaggtgatggcaatgcagagaaaaagctcatgagcagcgggaataaactaatgagtacaatgagcagacttcctatgaaaaatggctttctcgatggaattttcgttgtctggataaatcctgctgccccggaaataggtacaggcgcaatcgctccgatcaatccgctcagtaagtggccaaatgctgcgacaaaaccagccggacgagctctcttccgctcacgcagttcaccaaatgccttcactgaactttccacaattcgaatacttgccagcatgttcacaatgagtaatatcgtaatgaaaaaggacgtgacaagcaaaccactgtcaaaaaccggcattccgaatgggaatagtttcggaaactcgatgattttttctggaattcgaaccggctttgccagcccgagtagagcgaataacaaccagcctcctgcaagggcaaacaacacagaaaactgtcttaagtaatgccattttgagcggctgatcatgaaggtcagaacaataatcaagatcgataggcaaaagacaagcccgtccacctgatttccccgatagccgatgcccatcagccctttcatgatcggctgacttaactgcacaactaataatagcaagtaaatacctgtgacgactggcgtaaataaagacgcgagccaattaatgattttaaaaagactaaaaataaaaaagaaagcggcactaaaaattaaagctccttgtagtgcttgcagagtttcaggatacgttgcaaagatggttcctgtcatacctgcataaagggtatacacaccccaccaaagccctgctggactttcattgatcggcagcatatggccgcataaacattgcaccatcgccacaagaccaagtgaaaagaatgtactttgaatcagctccgctgactgcacttggttcaactcaaatgcttgtgcaatcgcaattggtacagcaatagaagctgcgataaaaaatgccatccactgaatggcgcccaaaaatagtttcaaaccgatcaccttccctttgtcgtgacaagaccattaaaaatcaaagatagagtcgccgttcccgtccttctctttttgcccctcttcttgatgctgaaatttcttcgcaccactcgcacccatcagtttctcaagcatggcttgatctgaggagacgggcggcgcggacggtgtctgtatcgaagaaggtggcgagataaccggcgtttgcggcatttgcacctgtgatggtgcatcgagaatgacatcacatagtgaagaaatcgccgccacttgacgtttcacctcttcatcatttccactttgtttcgccttttgaaccgcttcctccattttttgaagcaggcttgatatatgaatattcaagggtagaccctccaatctaaaaaagtctcttttcaacattattttaccaaatgaacaaacgaaatgggtccattttttcaaagcagtctgctcccgcctctcttatttgacccgacatagcccttcacacataataaaagaaacaacatcgtttatgaaaggattgaataatggacaaactcactgctctttttcagaaacaaaaagtctttcaaaagccgctgattgaagaacgcatccgtcttcttaaagacttaaaagcagccatcaaacagcatgagaaagatattttacaagccttggcccatgatttacataaatccgaacaggaagcctacacaacagagatcgggatggtgtatgaagaaatcaatcataccatcaagcaccttcacaaatgggcgaagccaacacgcgtgaaaacacccctgactcatatcggatcaaaaagcatgatcatcaaggaaccttatggaagtgtgctcatcattgctccttggaactaccctttccaattggccctttctccattagttggtgccattgctgcgggtaatgccgttattttaaaaccgtctgagctaacgccgcaagtttcagaagtaatcagtacaatcatgaaacatgtatttcaagaagaccatgcagctgtcgtagaaggcggagtagatgtgagtacagagctgttgaaactgccctttgattatatcttctttacaggaagtgtggcagtcggcaaagtcgtcatggaagccgccgcaaagcatttgacccctgtcacacttgagcttggcggaaaaagcccttgcatcgtcatgcctgatgcagatatcaaattagcggcaaagcgaatcacgttcggcaaatttaccaatgctggtcaaacgtgtattgcaccagactatctgcttgttcatgaatccattaaagaggatcttttgcgggaaatgacagcctgtatccgtgacttttatggcgaacaaccggaaacacatccgcactttgggaaaaatgtcagcaagcgtcattttgacaggctctcacaattcctctcaaatggaacgatcgtcacggggggacagcgcaacgaagacgagctcaaaatcgctccgaccattttagaccacatcacatgggaagatcccgtcatgcaggaggaaattttcggaccgattctgcctgtcatgaccttcgaatctctgcacgaggcagcacatatgatcaaagcaagaccgaagccgcttgcactttacttatttacaacaagcaaggaaacagaatcctatatcctagaccatctctcatttggcggaggatgtatcaatgacacgctcatgcatgtcgctactccttacctgccattcggaggcgtgggtgaaagcggcataggacgatatcacgggaaagaaagcttctttacgtttacgcatgaaaaaagcatcctgcgccaaacgaatcgcttcgatttttccttccgttatccaaatgcgaaaaacggactcgacttggttcgtaaatttttaaaataaacaggacgaagggtctctcccctcgtcctctttttattcaatatcttggatacaccaattgatttcttcaatccccatttgatttaaatacgcgtttacctttgagaacggacgactgccaaaaaagccgtttcttgcagaaaaaggacttggatgaggtgactcaatgatgtaatgcttgttttgatcaatgcgttctttcttattttgagcatgtcttccccacagcacaaaaacgacgggctgatcacgttcattcagcacatcaatcacgcggtctgtcacacgttcccagcccttgcctttatgagagttcgcctcgccctttctcacggtcagcacagtgtttaagagcagcacaccttgctctgcccagctcacaagtgagccgtgatttggaacaggacagccaagatcatcctttagctcctgaaaaatatttctcaacgatggcggatgcttcacgccaggctgaactgaaaagcttaatccatgtgcctgacctgggccatgataagggtcttgtcccaaaatcacaactttgacttcttcataagacgtcaaatgaagcgcacgataaacgtcatccggtttcggaaaaacggtctgcgtgcggtattcctccttcatccattcacgtaattcttgataatatggctgttcaaattcacttttcatcacagcccaccagctatcatttaaaaatggcttcattggggttctcctccttgtgtctgctgtgcaagccttgagatcatcggttttccgtcccacacaatctcactctctgattctcgttttttcatcgctggttcttctaataagacagcaaagttcgctgttggcaaatcgcccagcccgtgcttttcactgagatcatctaagtagttcttccttgtctcaccaagatcactagactgattcccaccgccgtcaaaaaacgcatagatcacactggcagctggtactcgtttgacccgggcatgctgcgtgacacgtaagaaaaagtcccaatcccagtaatgatgcatcgctggatcaaaatagccaatctcatcgtgtatacagcgtttgtacatactgccggaaggaacgtatgtagaaaagacacgcatatcctcaatagcagctgtatacgcaaacagacttcttgacacagggaagcgggtcgcacctttttcttcaaatgatacaatttctgcatcagaaaagacaaaatcggcctcctccagcgccttactcatacgttcaatatgacaaggtgtaaaataatcatcgtcatcactcagcatgatcacatcgcctgtcagctcccgcactcccacgtttctagcattcacatgctggacattctcatctaaatggatcaagcggatcggaagttcggggtagagttcctgaatgatctcgacgcgctctcctgcatcattcacaaccacaatttcaaaaggctgtacggtttgtctcttaatagattcaagcagctcacacagtgcgctgagccggttatgtgtcacaattaataaggaaatcttcatattcagcttactcctttaatagattcgtctttttccattaaaacataaaatggcgttcttctcatgatataaaaggcggtttgatatgacgggaaaatgggaatttttgatgaaaaggagtgatcatgatggaatatttcacagtagaaaatagcaaagaagccaaccagaccattgaacaaatacgttcagcaaaggatgatatttttgtttttgcgtacgatccagaacgctctgataccgtcacagagcatacgaatgccaaaagcatgacagcggtcgatcaagggattttagatcaaatggccaatgtcatccgcacccgggatgacgagctcatggccaaattgatgtcggttggcgccgatcaggaattagctttatcacttttagacgaactgaaaaaggggaaattggtgatttgtaaaaggtaaggggaaaggcgttcttcctagggtagaacgcttttttatgtcgtttcattgtgataaatggaaaagctgattataataagggatagaacagtaactgttacacatcacattggaggttcagcaactatgtctatgaataaagcactcaccatcgcaggctcggattcaagcggcggtgcaggtatccaagcagatttaaaaacgtttcaagaaaaaaacgtctacgggatgacagctttaaccgttgtcgttgcaatggacccacataaccattgggatcatcaggtgtttccaattgatacggcgacaattcgtgcgcagctctctaccattgtagaaggcattggggtagatgcgctgaaaacgggtatgctcccaacagtcgacgtgatcgaactggcagcggacaccatcaaaacatatgacctaaaaaatgtcgtcattgatcctgttatggtttgtaagggtgcgaacgaagtgctatatccggagcacgctgaagcactgcgcgaaaagcttacgccactggcaaccgtcatcacgcctaaccttttcgaagcaggtcaattaagcggaatcggtgagatcaaaacgatcgaacaaatggaagaagcagcaaaacgcattcacgaacttggtgccaagtatgtggtcatcactggaggcggtaagctaagcccagataaagcgatcgatttgctttatgatggacaaaccttcgaacgacttgaatcagataagatcgatacagattacacacacggcgcaggctgcacattctcagcagcagtcacagctgaactagcaaacggctcagacgtgaaagaagccatttatgcagcaaaagaattcatcacagctgccatcaaaggctctttccagctaaatgaatacatcggaccaacaaagcattctgctcatcgttttgataagtagaatagaaaaaaccgattcgccttgttaatgggcgaatcggtttttgtttgtacttacaagctcttgtataccttctctattctctcaaattcatcacgtcaatcacaacgaatattttgatcttttcaatatcatcaatgggtacaaacttcttcttgttctccaaataaatatacgtttctatcttcaattgacgtcacctttcatttcatgaaaaaaagcatacccgcgtctgggtacactcttttatccacaaggaatacctacttttgctgatcagattctttggccatttttcgaataaaggcttcaatagattcaacaaataaggcatattctttcatttgtttatacgtacctgacagcttctcttttaattcttcctgctctagagaaggttcaccgagaatagattggacttgaatgagcaattctttatattcttcacgtttatcttcaacatgatctgccattgtctccaagcgttttctagtcgtcggctgctgttttgaattcaagtaaacaacccctttttgtcctaccgcatttggataaacgtcagcctcagctgtatatattttaaaatgataccataattccacttgttatcatatatgtaaaacgtcatcaaaccgcttccggccacccttgtatatacatgatatagcccctaagatacaggttgaattcactagaaaaaagcagatcattgatctgcttcagattgttgacaaagggctaaaatgatcttgattttagccctttgtcttttcagcgtgatagaaaacctttgcagtctaggaaggacgagtactggcgcggagcgaatttgacattcgtgagcaccagcacgcaggactgacaccgaatgcgagggtttgtctacacgctgaagcagatcattgatctgcttttctttgtaaatgccatgtctttagtttaagctttgtttcatttctgccactgattgagattgatttatttcccggggaaggaaaataacgagcagtcaatacttctctgcctccgtttacaaaaatctcaattgacgatgcatcgatgaagatgtgaagggcatgtaattcctctattgccacttctcgaacttcttttgttcgatcttcaaatcgatctcgctctaatgtcagtttgccctcatctttatcataaatgataagggctgccgctcgaatacagcattcaaaccctttttgtgtatcaatttgatcaatgaataactctgcgctcgtaatatcatctacaggaatcgattggacggagcgtttgatatggaaaacatgctcctgttcgttggttctcatcgcctggagctcagtaactggcttttgaatcagatgtccgtcttcatctaaacgcagctctctcggaatggtgaggcagtgtatccattgatacgaaattgttggatgatgctcttctccttgatcaggcactcccatccatccaattaaaagtcgtctgcctgattcgtctaaaaaggtttgctgcgcatagaagtcaaagcctcggtccagctcctcaaacgctccgtgcgtatattgataagtatggtcatccaatttcccaacaaaataacctgattgatgtgtattatgatattttaagccatccggctcgagcccctgcggcgacacaatcaagacatcccggccatctaattcaaataggtctggacattcccacatgtagccgaaatcctctaatccatttttcccactgcctgcaatgatgccttgaaacgtccaattgtctaaagtatcagaggtaaacaggacgagattccctttcagattcagactttgtgcacctagaaccatgtaccactgaccatttcgcttccatactttcggatcacgaaaatgggcggtgaatccttctggcagcgtcgccacgacaccttttttctgaaaatgaatgccatcctctgaaacagctaaacattgatacgtctcgcggtttccttgttcatctcgaacgttgccagtgtacatcacatacatctgtccatcgtcaatgactgcactgccagaataacagccgttttgatcaaaccaatcacttggcgcaagggcggcttcctcgtgctgccaattcactaaatccgtcgatgtgtaatggccccaaaattttgcgccgtgtcccgttttgaatggctgccactgataaaaaacgtgataaacccctttccaatgaatcaacccattcgggtcatttaaaagaccaactggcggcattaaatgaaaatgctggcgatacacatcttttttcaccaaatgctcatagtttcgaatacgttctgctaccttttgacgaagtgctgcgtcagttgttgtcatgactgtgaccactccttgcttatttttctacttcttttactttaaacatgatagtgagagtaaatgagactgcaacagcgattaacataccaatcacataatttaccacattttgcacaccgaatggcgctgcaatcgcaatcatcggaatacctgttaaaccataagcgttggctgctacctttgtaaagacaacaaatgccccgcctaatgcgcctccaatcatcgcagcgataaacggcttacgatagcggagattgacaccgaatatgacgggctcggtaatccctaggaaagctgagaaggctgcaggaagtgcgatttcttttgttttcgcgcgtttcgctaagaaaaagaccgccaagcctgccccgccttgcgctacgttggacatcgcccaaattggcagcaaatagttacgcccaatatcattcagcagtcctgcttcaatcgcatggaagctatgatgaacccctgtgagcacaatgagagagtaggctcctccgaaaatgagtcctgctaagaaccctgcatgatcataaataaatgtcagtgcattcgaaattcctgtaccgagcattcttccaagtggtccaacagcaataaacgtcacaaatcccgtcacaatcaccgtcacaaatggagtcacaagtaaatcaatactgtttggaaccacttttcttaaattcttttcaacaaggcacatgatgtacacagtcaataacactggaatgactgttccttggtaaccaagaagagcaatatcaaaattgaataaatgcatatactctggtttcgcatccgtcagtccccacgggttgagcaggttcgggtgaatcataatccccccaataacggctcctaaatacggatttccaccaaactctttcgctgcactgaccccaattaaaatcggcaaaatgataaaggctgcacttgagaacatatcaagcatttggaagatcgcggagcttgggtcagcccatttgaaggctttcatcatacctaaaagccccattaataaaccgcttgcaacaatggctggaatgatcggcacaaaaatatttgataacgtctttgcaaaacgtgcgagtggattcattttttgtttcactgcttcatcatggctgacaggtttttgtttctcgtcgtctgtctcaaggccggtctcacgagcaaatggttcatatactttgttgactgcacccgttccaaaaatgatttggaattgccccgagcttgagaaagccccctttaccccttcaagttcctcaatggcatctttgtcaatcagttcctcatctttcatcaccaatctgagtcttgttgcacaatgcgtggcactgatgacattttccttgccgcctaatcgttctgttaattctttagctgttttttgataatccatgttgtctcctccttttttaaagcaaaaaagacctaaaattcaccaacgataaaaggacatacacgtcccctcgttacgcaaattttaggtcttgcctgcctgacagtcacaatcccgcgatatcaaattttgattacgctttcatcataatataagagcgtgatatgcgtcaacctcttttttcgaatctattgacccatatacactatttaaagtagtgtgcacaaaaaaaagcctgcatgcaggcacaaccactaaaccaattcggcatcctgcagacgctggacatgcagcgtgatgtagccgatctccgattcagggagatgaagttcatattcatttttcaacaaatcagcgagtccacgtgcacactggtaagccaaatcatactttgtttggataaaactcagcatgtcatcgtccatgatttgaaatgcctcatttgattccaacctgcttaatgcatacctcaaatgtgtcacaagccgctgataggaaatactatcctcatcaattgaatgctgaaaatagctttctatatgctcgatcatttctttgatcatcgttgtatatttcacggtctttttcatagactccgtattcattttggccgtatgaatatggagtgccacataccctgcctcatcgtccggcagttcaaccccaagccgatcctttacataacgaatggcatactttccaatatcatattcctgcttatataagactttgatctcaccaagcaatttattatatagcacaatgcccttttgaatgcgctctatagcaaaggataaatggtcagtcagtgatatatggatatgatcactaagcggcatcatcagttcaccctctgcataactgatgatatgctctgccacctcaatatgcgcttcgggcaatgtcgcaagaatttgtttgaatttctcattttcttcacgcacaacaaagattttctctattttttgaacgggaacgacgtcatttttccccttctgaaaagcaattccgggccccatcacaattttctcctgatcaccttcctttacaaccactgcattgttattcaatattttatatatcttcaaggggtatcctctcccaccagataacgtttcttatgtgggattttaccctgtttcatctcccatgtaaaggtaagagcggaccagcacgcgcctctctcgtcgtcttctcatcaagcatcatcagactttgcttaaacggtttctctgacctgcgcttcttgttcttttcttctgccagcttctctagctctccctcgttcacaacttgaaagaaacgatcatccaccgcagcagccgcctgaaaacgttgctgcttcatcatcacaccaggattcacaagcacattcatcatgaaaccaaaccatacactcaaccagtttttgaatttcttcactgaacatccctccgcttttcttagaatctagcagttctagcaaaacaactgctcctatcatatcccgagaaaaaagagaggtttgtcacaatctgggtgaaaaaacaaactagttttcagaagttttgttgaaaagtggagaagatgatcatgtatgagggtgtttgaataaaaattttatacacactatatccaaaagataagcacaccttatcaacagggtttatccacatatcaacaccctactactagattttgtgtatgggatttttttattttccatatatatatctaaataattgagttatcaacagaagtttgtgcataagtgagactttataaacaaaatagtcctttatgactatgcaaaataagaccattttagtaaaggaattgttttcatcgtattgaatacttaataacgggcagtgaatctttcctatttatccacaaaaagaaaggctatctccctaaaaacacagctagaaaggggaaaattaatgaaaaaggttatctctcgttcttctattctattgttctccactatttttattttatccacattctttacaggtcaacaggctagtgccgctccatcgaacaaacaggtggaactggaaaaagcagaaatcttcggtgaaatcaatgtcaaatctagaaaacataccactgtcattgttgaattaaaggaaaaatccttagttgaagcaaagcaagaaggcaaagctcaaacaaaggcctccctcaaaaaatctcgaacaaaaataaaaaatgcagcactcaaagaagttgataaagcgagtgttcgtcaagaatatgaaaaagtcttctctggtttctctatgaaacttcctgcaaacgaaattccgaagctactcgcagttgacggagtaaaagccgtttatccggatgttacatatcaaacagatgaagtgaaaaaggaaagcattcagcttccaaatgaagatgtttcacctcttatggataaaagcgctccatttatcggtgcaccaaaagcttgggatgccggctattctggaaaaggggtcaaagttgcagtcattgatactggagtagactatacccaccctgatttaaaaggaaacttcggtttatacaaaggctatgattttgttgataacgattattctccgcaagagacacctaaaggagaccctagaggtgaatcgacagatcacggcacacacgtcgcaggaacaattgctgccaatggacaaattaaaggtgtcgcaaaggatgccacacttcttgcgtaccgtgtacttgggccaggcggttctgggacaactgaaaacgtccttgcaggcatcgaccgtgctgttactgatggagcagatgtcatgaatctctctctcggaaacagtgtgaataaccctgattatgccacaagtattgcactcgattgggccatgtctgaaggcgttgtcgctgtcacatcgaatggaaacagcggtccaaacagctggacagtcggatctcccggcacatcaagagatgccatttcagtcggagcaactcagcttccgtatagcctttacaatgtgaaattcccgaactattctactgcaaaagtgatgggctactaccaagagagtgatttaaaagcacttgaccaaaaacaagtcacactcgtccatgcaggtatcggtgacgaaaaagcatttgaagacatcgatgtgaaaggaaaggttgccgtgatcgaacgaggagccattgcctttgttgataaagtcgacaatgcaaaagctgctggtgcaatcggcgttgtgatgtataacaacaccgatggagaaattccagtcgatgtaccaggtctcgctcttccaacgattaagctatcaaaagctgaaggaacggcgcttgtcaaagccattgaggctggaaacaatacaacgactttctccattcaatttgtcaaagagcttagtgagcaagtcgctgacttctcctctcgcggaccagttgtggatacgtggatgattaagcctgatttatcagcgccaggcgtcagcattgtaagcaccatcccaacgcatgatccttctcagccttacggatatggctcaaagcaaggaacaagcatggcttcaccgcatgtggcaggagttgcagcgatcatgaagcaagcaaaaccatcttactcaacagaacaaattaaagcattgctgatgaatacagcagaaaaactattcgacgcaaacggcagcccattccctcacaacacacaagggacaggcagtgttcgaatcatcgaatcactccaagcgtcatctatcgtttctgatgcgagttattcttacggcactttcttgaaagaaaaaggcgttcaaatcaaaacaaagaaattcaaggtagaaaacctatcaaaggcaccgaaaacgtataccattgattacaaatttgatggcagcggcatcagcacaaacggaacgaagaaaatcactgtcaaagggaattccacggggtcctttacttccgcggtacaagtgaactacggtaaaaccaaaaaaggaacgtaccaaggcagcattacccttcgtgaaaatggcagaaaggtcacagagattccgactttattgattgtaaaagaacctgattatccgcgcgtcacttcggtttctgtagagccggataaccgtgctggaagctatgtcattagcagctatctgcctggcggagctgaaaaccttgcattcctcgtctactcgacagatggagagtatttaggtgaagcaggtgtttatcaacacgttgataaaggagaacaccgcgtaaaatggaatggcacaatcaatcaaggtcaaaaactcgaacctggtgagtatacaatgcttgcgtatgcaagtctgaaaggaaaatccgatactgttcaaacgaaggaacctttcgatatttaccctgaataaatgtgaatcacaagaaaagccttgtatgagcggatcaactcatcaaggcttttcgatcatatatggaggaaagagagactgatgttaatattgctatggatcgtttcttgttttactgctttttttctaacgatcaccttggtgtattttttcacccttttatatgcgaaacattctcgtccttttcatcaagcatgcgagctgacggtctatgtgtccttcatttacccgcttagtttgcttgtgacagcctcgtttattttcatcatgatgcttctcttccctctctactggctgcgtggacgttaaacagacatacatacgttatgcatcaaaggcttcttttaataaacgataagatgtgagccggtcttgcatgcggtgagtgatggtcacggcgattacttcatttgtacgataagccttcgttagtgctgtcagctgctttttcacagaagatggcgtccccaccaccatcctttgacgattggcagccactcgtttttgttcatatggactataggaataagcttgtgcactttcatatgaaggaaagcctccgaggttttgcccctgttcattggcgagtaaagataaatctaagctgactgccagtttttctgcctgctcctctgtttcagcacataaaacgaagaccgcgagactgacgcgcggctcatcaccgaatgctgaaggttcgaaccggttgatatattgctccacagaatcttctccgccttcaccattgataaatagtgcaaacgtatagcctgcacctgcttttgccgcaagtcttgcacttcctccagaggaaccaagcatccatacctctggtgcagtctctactttcggagaagcggttaaatgggggagcggataaaattcatccgctaggtcgtgtaaatagaccttcaactcttctacctgctcaggatattgatcacctagacgttttcgttcaccatgatgaagagctatggaggaaataggcataccgccaggagcacgtccaatcccaagatcgattctgccaggagcgagggcttcgagaaccctgaagttctctgctactttataggcgctatagtgaggcagcatcacaccgcctgacccaatacgtatatgtgacgtaacggctgataaatgaccgaggagcacctctgggctcgatcctgcaagccggtttgaaaaatgatgctctgatacccaaaaacggtgatagccccacttttctgcctgctttgccaattcaaccgtttgcttcaaggcttcagcaggagttgcatctccaatcaaaggagattgatccagtatacttaatttcatcttcctgcacctcttacagacatccccctctctccatcgaaagggggatgtcttatttattttcgattaaagcccttctctttcacaaattctccaaggaaggcacgctttggctgactaaagccgcgaagcatctgcttagaccaagtatcggttctctctccgtttgtccgttcttcataatatgatgaaatacggtcatcgtattcttttaaataacgatccacatgcgtttcatcttgctgatatgaattttcatgataaatgagttcaactggcagccgttccttttgtgacgattgactcgctggatgtccgacaaccagaccaaataacggcagcacatatgatggtgtttcaagcaaatcagagacttctctcagttgattgcgcagaccgccaatatagcagatcccaagtcccattgattctgcggctatactcatattttgcgcagcgagcgccgtatcaatgacgctaatgagaaaggcttctgtattctcaagcgcctcctgatgattcttccctgctttttttgcaatatcatcatggcgtttcaagtctgcacagaagacaaagaaatgcccattcttctcaacgtatggctgattcccagccagttcagcaagcttggccttcttctcttgatctgtcacaccaataatactgtacgcctgtacatagcttgatgtcgaagcagcctgtgcgcttttaatgagtgtcagcacctcttcttcggacaaacgctcgtctgtaaacgaacggatggaccgatgatttaatatcgtttctatcgttttgttcaattcgaagacctccttcacttctactatcataagacaaagacatatggcttttcaaaaattaaaactcgaatgaaaaaagacagtctatgcttagactgcccttacccgttttatttaaataaataactttggtatttcgttaattgaacacttgcattataagcaatcccaaatccaatgagaacagataagacagagcttcctccgaagctgataaatagaagcggaattcctgttacaggcatcacacctatgttcatcccaatgttctggaacgtatggatcacaataagtgctgtatatcctacacagaagaatgacgcaaatcggctataaggatggatacggtcaatcagtacgacaagccggtagatcaagaagaagaacatgatcacaacaaacgcacagccaataaagccaaacgcttctcctataatggagaaaatcatatctgtttgtgcttctgggacatagacttttaagtttttaactccattcccaaaaatctgtccagcaccaatagccataatggcctggtctacttgatatttatcagacccagacgcatcctgagtctgcgcttggttggctgacgtagagctatcaggcagccaagcggtaatccggttgatctgatactgctgaatgccgattgtttttgcaacatcagggaaaaggatgatcacggctaacacagcggcaactaaaagcacaaccacagaaccgatgagagaaatcagcttccaattgacccctgataaaaacaccatcacaacgacaataaacatacagacagctgccgtacctgcatcctgtaagaaaatcagtccaactggaacagccgctacaccggcaatttttaatagtaggaagatatcgtcttctaatgtccgttttcctctagggcttgatttgccgatgacagatgcaagcatcataatcaaaccaattttcatgaactctgagggctgaagtgtcccaatccccggtatcacaaaccagctttttgcaccgtttttaattggggcaaaatcatgacctccgatttgtgcaggagcgactttcagaaaaagtaacaacaggatgccgcctataaaaatataaagacttagcttctctaattgctccaaatcaaagtaatttatggctacaatacatataacgccgaccatgtagtaaatgatctgcctcgtccatgcattagatccatactgcccaaattgacccgcagcataaattgcaatgacactaatggcaaagaaggctaaaaatataaaaattaaatccccttgatagtacggagatgtattctgcttgttcatgaactaaccacccttattacaaaacataaaagcccttatttatattagattgaaattttcacaaaagcaactcaccttaaatatgacggaagatacatccgaaaggttccaatcatttttcaaaaaatgaaatacttttcatcctaacaataggaaaaaattcctctatactctttccattcaaccgatcatgagtcctttaaaaagattattttacagatattaaggggaaaattcaatgacctatgtggtgatataacaagctatgatcttgccagcataagctgtacggagagaaaaggaaaaagccgctttctacggaataaggcccattttccaattattgcgtttacttcaaagtcaattgtggtataatacttgtaacaaaatgttcacaatatctcctaaaaacagacacaattgcatcctgacctctcatttgaattgaacatcaacttacaaaggagttggatacgatggatatgttctttgcgtacctatgtattgcaacggctacacccctgtttttatggcttgaaaacagaaaaattgcactagcttctattccacctattatgattatgtggattttcttcggtctttacatgacaagcagtttatctccagcaggacataccttcatgatcgcattctttgccattaacgtcattttggcacacgttgcagcgttcctcatttatggacttccattcattcgcaaaagattcagtagcaccagataaacaacgcaccacttattggaggcgttatcaacatcatgataaaaaccactcacctttaagagatgagtggtttttttattatttctctgaatgctcagattgctttggcgcagaaggtgaataaccgtctttgctgttctctccgtggctgtagtgagccgcaaagatccaaacagatccgataacgaaaataatcgcacaaaacagaccaaacaatgtatttccgacttgaacagttccgttctcgctttctgtcatatgcataaacatgaatagctgcaagaacgcttgaatgaaagcaaaaccaaagataatccatagttttgcagaactgccaatttcagctccaatggcaatccagaatgctaagatagttagcacgatagaaagaatgaagccaactacgtgtttccaagggaagtgttcgtgctctgctgaggaatgtgtttttccagccatatcacaaaagcccccctaatccgatcaagtaaacagctgtgaagatgaaaatccagacaacatcaaggaaatgccagtatagacttgagataaaaatcttcgctgctgtttgtggagttaatccacgttttttaatttggaacaagaccccggtaatccagaagataccgatggatacgtgtagtccgtgagttcctaagagtacaaagaatgcagaccaatacgcacttgtatggatgctcgcaccctcatgtacataatggaagaactcgaaaatctcaaagccaacaaagcctgcacctagaagcagtgtgagaatcgtccaaatgacaaccccttttgtacttccacggcgcatttcatgaacagcaatcccgcatgtaaatgaactaaccaatagcaggaatgtcatgatcaatacaagcttcatatcaaacagctcagctggtaaaacgccgccagctgttctgccatgaagaacaaagtaggtcgcaaaaagtgttgagaataacacgatttccgcgccaaggaatatccagaaaccaaggatgtttaaacgtcccgtttcagactgatattcaagcggtgcatttgcatagctgctatcattatgtcccattacttctgcgcctccttattctttttctctgtttcaatcacttcttcaacaggaatatagtagccatcgtcatattcaaatgaacgtaaaatcattgttgcgaatacaccgattaagccaataacgccaatccagtaccattcaaatacaagaccgaatgctccaagtccgaagaatgcagacatgataagcggtctgcctgaattgtgcggcatgtgaatttttttgaattctttttcaggatgaacgtctacattgttttgcttccaatgatggaatgcatctggtgttgtcacttctggaagtgctgcaaagttataatgcggcggaattgcagaagatgttgcccagtcaagagtacgtccttctccccagctgtctccagacacttcacgcttcgcgtgtctccagctgtagtaaatgttgtagcaaaggatgatgaatccgacacccatcataaatgcaccaattgttgaaataaagtttagtgcagtccagccatcttctggtccatacgtataaatacgtcttggcattccttgcagtcctaagaagtactgcgggaagaaacagatgttaaatccgatcatgaatacccagaagaaccatttgccgattctttcgtttaacttgtaaccaaacatttttggataccagaaaacaagaccagcaaaacaagcaaagacagtacctgcgattaatacatagtggaagtgggatacaaggaagtacgtattatggtactggtaatccgcagctgccatcgcaagcataaccccagtgacaccaccgataacgaagttcgggatgaaaccaagtgcccaaagcattggtgaagtaaagctgatacggcctcgatacattgtaaagagccagttaaagattttcacacctgttggtacagaaatcgccattgttgtaatcgagaagaatgagttaaccgctgcactgttccccattgtaaagaagtggtgaacccacacaaggaaactaagaacagagattgccacaatcgatacaaccatcgctttgtaaccaaacaactgttttcttgagaacgtcgcaaagatttctgagaaaataccgaaagccggcaggataacgatatatacctcaggatgtccccaaatccagaaaaggttcgcccaaagcattggcataccgcctgcttcgagtgtaaagaatgcagaaccgaataaacgatcaaatgtcataagtgctaaagcaactgttagtacagggaatgcgaatacgatgatgacagacgtgatcaatgttgtccatgtaaacattggcatacgcataagcgtcataccttttgtacgcatttttaaaatggtcaccatgaagttaataccagtcataagtgtaccaatacctgcaatttggagcccgagcaagtaatagttctgtccaggtcctggtgagaaatcatttccggcgagcggcatgtaactcgtccagcctgcacttggtgatcctccaattacgaaggaaatgttgaacagcatcgctccgaccataaatgtccagaagctcaggttgttcaaataagggaatgcaacgtcacgtgcaccaatttgaagaggaacaacgacgttgattaaaccaattaaaaatggcatcgccatgaatagaatcatgatcgtaccatgcgttgtgaatatttcattatagtggttggaatctaaaaacgtattattaggaagcgccagctgtgcgcgcatcatcagtccgtctaccccaccgcggaagaacataatcacagcagcaaggatatacatgatcccaagctttttatgatcaactgatgttagccattctttccagagccatttccactttttaaagtaggttaaaacaaacacgatagcaatggaagtaagagcgatagaaatttgcgcaccaagaattaatgggtctccagttacaaaaaactcatcccatttcaaatgcataacggcctcctcctttccttagtcagtttattcattatctagttttcttttatagttcttcacattctcgaaaggatctgttttggaatgcggagaaactgattggtaacctaaacgtttgcgtgcttggagtgcgtattcagaatcctctccatgcttcgcaaaggataaatgtgttgatgagaatgtctgcacatctgcagcatcaggaagcatcaagtagtcatacgttttcttcgttaacttcggtgcttcttttttcgatttgcttacccatttatcatagtcagactgcgtcatcgcattgactttgaatttttgctgagcaaagccttcgcctgtgaagttggcgtttcttccttcatatgtgccaacttgatcagcttgaagatattgttccatctccattccagccatcgcatacttctccccgcctagctgaggaatccatagtgatgccattgtatcagcagaagtgattttgaataaaaccggctgatcttttggaatgtttaagtagttcactgtctcaatattttcctctggatagctgaagatccatttccaatcaacagctgtagcataaacgacaagaggatctttatggcttgttgcttgaggtgcctcttccaaagagtaaattgtttttacagttggaactgaaagggcagcaacgattaatattgggatcactgtccagacaacttctagaagcgtattcccgtgtagttctgggttataagaggcgtttccaacgtccttacgctcacggtatttaaccaaaatgatggtaaacagtacaaataccgcaccaacgataaagagcatgaatccgatggataaaaggattaagtctttttgttgtgctgcgacaggtcctttaggatctaaaacagcgatattgctgcaacctcctaataaaaaaacactcacgagcatcgctaataaaagcataggtttaatggctctgaacaagaagatcaccatccttccttagataatgtataaattgctgaataattgtgaaaagccatctgccttcgaaaacttttcttccatttgtaatgctatcaaaatctgttagagttagcttcccttttttcaaaagttcatttatttttcaacagatttctattaaaatgtcataaattcgacataactttatattattgcacacacaataaatttctaggattttgaaaagttgagagttgaaggcaaaggacaaacaatcaagaactttgtcaaatttaggtttaccacaataaaaaagtttggtcaaatttcaatttaacttaatgaaattttatctaggtaaacaatttcgaaataggcatccccacatttaacaaaaaccttactcattttaacgcaagttcacaagaaaagaaagtatcgatcctctgtgtatacgctgtaagaattggtaatgatgctgaattagtggaatctcgctaaagacttccagcaaaaaaccggctcagcgccggcactctgcatttattcatctctcactaagatgtcaggtcgtctatagatcttcccttcatgttcaatgtccatgtacgtccacttgcctgtatacgttaaaaagcgattgccctctttttctacaacaatcgtatcctctgatttcagtccaggcaatgaaggattccatgtaaacacttgatgcagctgaatttcttccttcgatgagggaacggcaatgatttccctagatacaaatcccgtctttcccccttgatgaagctttttccagctatcagggaagccctctttttcgtactgagcaatacctgctttcagaacatcacctaatgttttcccaggacgtgtggcggcattcatgaccgtgtcaattcgtgctagccgctctttgttctcttcaagctccttcggaagctgaccaaagtaaacagaccttgtgacatttgcaacgagcccgtgccgctccgcgcagagaacaacaagcgcgtgcttttgaagagatttatctgttggaatcgggtgacggtattgatggatccggtcatccgttgccacaagcagaacctctatcgtcatcccttgcgcaatagctctttgggcaacaagtgaagcaatttcgttctcggtctgccctggaacgatttcttgacagacactttctacaatgaccgctgtttcatgacaaagcgtttcatattgtctgagctgtgaggcagtaaggatcgagcggacatgcgacaaattcggttcaatccattcgaatccatccatttgaatatccgtcccaattcgtttaccttttgcgagttcttgaatgtatggggcctcatcctcataccaatccattgtgaccacttgattcggatgatcgacgtgcgccatttcttcttcaatgatccgcttttcttccatttgattcacaatgagaacgaggtcgtcttttaagacgagcagctgacacacgccctctggcgtatttaacacaatgtgattccttcttccgcctgtgagccaggagaagttatttcgcttttgaatcaaaacaccatcgagctgcttttcttccattagctctcttacttgttcaatcatctaatcacctgcctgtttgaagtgtttgaatgaaacggttaaaagctgttttcccttgctcagttcttttaaacacacctgcttgggagagaattcgagaaaaaataatgccgatttctttttgtaaaatggtttcggtattctcctctgtaaaggcgttctcttcaagcagctgctttgcccaagtctcgtgcttcatgatcgcaggccgggctttgatttcttcaagtgggctttcagatagcaaagcctcttttaattggcttaattcctctgctaatctaccaggaagcacagcaaggcccatgacttcaattaatccgatattctcttttttaatatggtggacttcttcgtgcggatggaaaatgccgtccgggtgctgcttgtctgtacggttattacgcagcactaaatctaattcataggcatccccgtggcgccgcgcaataggtgtaacggtattgtgaggagtctctcctgtatgagcgatgacccccacctcttcatctgaatacagtttccactcatgtaagataaagtctgctgcatctgcgagcgactgccgctcactgcttcgaaggcggatcacagacatcggccatttcacaataccagcttgcacatctgggaaggcgttgagagaaaagacctcttccatctctgcttttgccatcgggaattcatgggcaccaccctgaaaatggtcatgacttaatatactgcctccgacaatcggaaggtcggcgttcgacccgatgaaatagtgcgggtatatagatatgaaggaaagcagtcgttcaaaggtctctttggtgatgctcattggctcatgtttgcctttgaacactatgcagtgctcgttataatacacataaggtgaaaattgcagaaaccacgattcacctgagagtgtcacaggaataatccggtgattctgtctcgctggatggttaatccgcccctcgaatcctacgttttctttacaaaggagacaaagaggatattgcttttgactgagcttcttcgcttgagcgatggctttagggtctttttctggctttgatagattaatggtgatctccagcacgccatcgtctgttggtgtaaaccactgtacatttttggcaatcctgcctgtatgaatgtagtgggcatgctgctgcatttcatagaaccagctcgtagctgccttcggtcctccctgctgacgtttttcctcaaacttcgcatagatgacacttggaggtgccaccaaacagcccatgattttcgcatctagtaaatcacgatacgtatccgtcccctcagggataagtcctgtttctactgcccaatcgagcatcggcattaagatgtcttcaaggtcttctactgagactgagactgttcttgcttccgcttcatcgagcctgagcacctcaagcagtcgatttctcgtatattcgatatctagtgatgttatcagctctttattaatcccgtattgaatcagctgttccagcttttcaaaaatatcaatcgccattccctcagtcccctctcttgcctgcctttacgttttattcactttgatagccatctggatgcttctgaaaccaatcccacgcactttgaatgatcgtgtgaaggtcagcatattgaggtgtccatcccaattcttgcagcgctttttcagaagaagcaatcagctttgctggatctcccgcacgcctttttgccatttgtgccgggatagcatgccccgtgacttttctaacagcttctacgacctgcttcacggagaaccctgttccattccctaaattgtaggtcgcactgccttttccagcacgcagccggtcaacggctaagatgtgtgcctctactaagtccatcacatgaatgtaatctctaatacacgtgccatcctctgtctcataatcatcaccgtaaatcatgatttgatctctttttcctaaagcaacttgcagaataattggaatgagatgcgtctcaggctgatgatcctctccgacaagtccttctgtatgggcaccagctacattaaagtagcgaagaaccacgtattctattccatacgcttctttagaccacttcagcattttttcaatcgctagtttcgtttctccataaggattcgttgggttcgtttcatccgtttcaacgatcggcacccgcttcggttcaccgtatgcagcagcagttgaagaaaagacgatgtgtttcacatcaaattcattcatgacttgtagtaaagcagttgccccacctacgttgttgtcatagtacttaagcgggtctgttacactctccccaacaagtgaatctgcagcaaagtgcatgaccgcttctatttgatgtgttttgaacacctgtcttaaaaaggcgtgatctcgtaaatctccctcctctaagacagctccttccaaaacagcttctttgtggcctgtctgcaaattatccactaccactactcgttcgcctttcgctaaaagagccgctaccgcatgactgcctatgtaacctgctcctccacaaactaaaattgtcatcacacttccccctttgtgagttctcttgcgccgcctccaattccagctgtgtaaaaagaggcttgaatacctgttttctcttgatatatcgcaccagtttcttctataaatgaatctagcagctcttctttcactatgctgatcgtacatccgccaaagcctgcacctgtcatacgagagccaatcgtccccgggtgctgccaagctgcttcagccagggcatctagttcaaagcctgttacttcataatcattctttaaagaaagatgagaagccttcataagtgcacctatttcttccattttatcatctttcagaaatttgactgcttttatggtccgatcgttttctgtcaccacgtgtcttgcacgtttgcggcatgtttcatcctgaatcaagtgagcgtgctcggcaaattcatctgccgttagctcacataagtgggcaagatcgatttcttttcgtaaatcgtttaaggccgattgacattctgcccggcgctcattgtatttagaatcagccagtgtccgttttttgtttgtattggcgatgacaagcgacagtccctcttgccgaaacggactatattcaaaggcaagggtgtcacaattgagcaaaatggcgtgatcttcttttccaagggcaatcgaaaactgatccatgatcccgcaattgacaccaataaattcattctctgcacgctgtgaaagaagagcaagatcgacatttgaaacgctgaatgaatgccattcattgatgagaacagcggtgacaagctctatagaggcagaggaagacagacctgcgccatttggaatattgccgctgtacacaatgtcaaagccatcttctatcttcattcctgcttctataaactgcttgaacacacccttcggataatttgcccagccgtccgactctatgtaagcgatttcaaaaagattgaattctttcacaccatcgcgatcaaagttcaaggaatacattctcacgcggccatctgaacgctttgcacaggcagcatacgttccgagagtaagcgcgcacggaaacacatgtcctccattgtaatctgtatgttcaccaatcaagttcactcttcctggggcaaaaaaatagcgaagttcttccctttctccaaattgctggtgaaatgccgcgcgtaacgtatcgatcatatccattccccttttctcttctgatacttttattttagttgtcccaggagcatcagttcaatggtaaaaaaatcgttaaaaaataccctttttttgctgtgaatggtacgatgtgatatgaggtgtaacatgattctaaatagaaaaaggttgttttttgctgtgaaggagggtttccaatttgaagaaagaagcatttgcatttcgttttcaccattctgatgtgacattgccggcacaaatctggtctgttggctgggaagttcaatcttcttcgttatatagctggaatggcgtggagcggaaggatcaaggcaagtgcatctttcagctcacactgtctggacatggcatgattgaaatcggagagaaacgtttcaaagtattgccgggtcaggcctttctcgtgaaaagcccaagtgcctaccaatattattttccagaagacagtgagcattgggaatttctctatttaacgctttacggggaagcctgcgatctttgctttgaccaatttattgaccaaggaaagcaggtcatgcgttttcatccgaattccagaccgatccgcctgctcaagaccatttatgatgaagccagtgaaagacggattaccaatccatttgaggggtctagccttgcttatcaatttgtcatggaactgtattcatatttgccaaagcttgagggacaaatggagaaatggcccgagcccatcgttcaagctgccttgtttgccagccatcattttcacgaggaaattggcccagacgatatggcagctgcggcacgtttatccaaaagtcattttacaagggaattcaaaaaggccactggcttcacacctattcactatctaaccaatattcggttagaaaaggcggaaacgttattgaaaacaacaaaatactcgattgaagaaatcgccatacagtgcggctacagaaatgcgaattacttgaataaagtctttcgaaagaaaatcggcatgtctccaaagcaactgcgggaaacaagcgatgcataataaaaagcagccgctttcacaattggctgcttcttttacgctttcgtcagatcaacatgaattctcccttgtcttaaaacaatggtcatttgcgtgtcaggtgtcattaagttttccaaaatgtccgttgctgtttgaagcgcaatgtccattcggttgatcttttccttttcttgttccgaaaacgcttctggatgtgcggtcatttctttgactagcctcagcacttgttcatgctgcttttctgtttgctgatatatgacatcatataattcgtctggcctgctgctcatttcacatcacctatcttttttcatgtgttaaatcgcatcttcttttgttttcttgaagacgaaccatttgctggcgacataattcacgaccacaatcacaaagttgacaagaatttttgcgacagtttcattgagcgccatttggctcacaaataaaatcatcagccctagatctacaccgagagacatgagacgaacactaaaaaatgaagaaagctcacgcataaggcttttcgtatcacgagccttttgcttgaagacatacttcttattggtgatataagcaaagagaacagcaaatacccatgaaacaactgtagctgttttataatccatggaaaacatctcaacgaataagtagaagctgactatgttgacgatggttgtacacacacccatcacaagatacatgacaacttcttgatacttttgaaaaaggctatacatgtctttcttcattccttcttggtggtttctgtttcttttagaataccatcttgagaagaacttcccaaacgaacaatatgtacgtcctgcacagatgaaatttgttctactcgatggcaaatgtcaacctaattggtttatataagccaaatgttataggtctttttcattattttaatttataatcttttaactgactttacaattgtttattattagaagtaagaaatcaatatttatgggttttttagtcatttttttaggaacgtggtaggtgatagattttacaaaataggttaaatgtcatcatttttcgacaaaatctattttgcgctgttttcatccacacgtacagttactagacggtttgttcaagtcattggttgcagatgaatatgtcttattgaactggaggatattatggatacgcaagtgaaaagaagagttgacgaagagtgggtttatttgattcaggaagcgaaaaaaatgggactagccatcgaagaaatacaagcttttttaacatccaacggtgatcagaagatgataaacaaaccgtaaatcaacgccgttatcctttgtctttcagactgctttggctaaaagttctgacttgtcaattgaccttttgaaaatcctttcatgacgatacgctacagtagaacaccccttcataccaatcccttccactcatggggttctgtctttctatattaggaggacagtccgtttcccgttctttatatgatccctttttagccactattcatgaaaattgtccttctctcgttataaaaccaagctccccacccatatattaagcatgaaagcaatgagaaagcagagaggtgggtagagcgtgagttcagattccctttcctattatcaccaaaaaaaggatcagtattatcatggcgtgaacccggtcattgtcagccgtatccgcgcggaatggacgtctttattagatatcggatgcggcacaggcaagcttggaaaagtcctgaaacaaaaggaccggaccatttatggaattgaatcgtttgaggatgcagcaaaagaggctgagcaggagctagatcatgtgctatgcggaaatattgaacagatgacgctcccttacgaacaggaacaatttgactgcatcatattcggagatgtccttgaacatttattggacccgtgggccgttttaaagaaggttaaacccttccttaaaaaagaaggagccatcttgtcatccattccgaatatcggtcacatatcaaccgttttagaattattagccggcagattcacttatacagatgcaggattaatggatcaaactcatttacgtttcttcactcttcatgaaattcatgcactctttcattcagcaggctttcgtattcgagaactcgaaaccattcgcgtacagcacccttcctacgagagcgtgatgaatgatttacatgaattactcatgaagcatggcattcgttcagattttcatgaggccgctaccgcctatcaatatgtggttgaggcggttcagcttcatgagtaaccccaccatcctgtttgttttatgtgtaaatgatgagtctatgtttcaggcttgctttcggcagctcgcttcacttcccgctccccatggatatcatgtggaggttttgccgattagacatgcatccagtatgacctctgcttataatgaagccatcactcatccagctcagtttaaaatttatcttcatcaagatacattgattgtcaaacagcatatgcttcttgagttgatcccgctttttttacagcatccatcacttgggatgattggggtcataggtgcagaaagcgtgcctgacaatgggatatggtgggaaagttctgattgcagggggaaagtcattgaatatcgtcacgacacttatcagctgctttcatttgaaagtggtcgtcaacaggcagacgcgcaagattacatgaacgcttcggcgattgatggtcttttcatggcgacgcagtatgatgtgaagtggcgtgaggatctctttgatggctttcatttttatgatgtttcgcaatcctttgaattcatacaacagggctatgaggttggcattgtgaggcaagaagagccttggtgcatccacaaatgcggagatcattttgatgcggaagcgtatgaaaaagcgagacaaacatttcttgcaaattatcgatagaaagcacccttttcgggtgccttttttatgatatactgtcataaacaaccagatcgtctcatatgcattggagtaccttgtccctaattcgtataaaggaggaaacaatggcagacaaaaaagttcattataagaaggttgccgcttcagaggattttcgaaaacttcttgaggaaaaacgcagatttatcgtaccgatgacgattttcttttttctcttttacttttcacttccggttgctacatcctacttcacctttttgaacacgccggcaattggcgcgatttcatgggcgtggttattcgccctcacacaatttgtgatgacctgggtattatgtggactttatgcgaggaaagctgctcagttcgacaaatatgtaagcgctttaaaagttgaatcaagaggtgatgacaaatgagcatgaccgcttttattttattcatagcgatcgtagggctcacattggtcatcacatattttgctgcgaaaaaaacgagcaatgcgagcgatttttacacagcaggcggaggtctgactgggtttcagaacggccttgccatcgccggggactatatgtctgccgcttcatttttagggatcgccggaatgatcgctttaaatggatttgacggctttttctatagcattggctttctagtggcgtatcttgtcgttctttacgttgtggccgaaccgcttcgaaatctaggaaaatatacgatggccgatatgattgctgcacgatttaagcgtcctgccattcgaggggtagccgcgtttaacacaatcacagtctctactttttatatgattgcacagcttgttggggcaggtgcattaatcaagctgcttcttggcattgattactggattgcggtgctgatcgtaggtgtcttgatgacgatttatgtcgtgtttggcggcatgattgcaaccagctgggtacagatcacaaaggctgtgcttctcatgcttgggacactgattatttcactgcttgtgtttgcgaagtttgattttagtctgctgaagatgtttgaggagatgaaaacagcgaccccgctcggtggggcatttcttcacccgggaaataaatatgatgtgcctttagagaccctgtctttgaaccttgctttagtgcttgggacagcaggtttaccgcacattttgatccgtttttatacggtgaaggatgccatttctgcgcgtaaatctgttctatccgctacgtggatcatcggtattttctatttaatgacggtattccttggcttcggtgctgctgcctttgttggaacagactcgatcaccgcagcagatgcagcaggaaatatggccgccccactactcgctcaagcccttggaggagatttgttatttgcctttgtttccgctattgcctttgcgaccattttggcggtcgtaactggtctcgtcctatctgctgcgtctgcctttgcgcatgacttttatagtcagatcatccgcaaagggaaagcgagcgaacgggaacaggtgaaggcggcacgctttgcttccatcggcgtggccattctttctatcattctcgcattatttgcccaatcgttaaacgttgctttccttgtgtcacttgccttcgcagtggcagcgagtgcaaatttgccattgattatcttcactgtcttttggaaacgatttaattctacgggtgccattgctgggagcttagttggacttttgagcgcactgattatcgtctcgctcagcccaagcgtctgggacccatcgggagcagccatctttacaggagacccgctcatcccgctgtcgaaccctggaattatctcgatcccgctcggattccttgccgcttacttaggcacgatcttctcctctgaaaaagctgatgaagacacctttacggaaattcaagtaaaggcacatacaggaatgcatatggacactgattcataaggaaatgccggcctcagattgttgacaaagggctaaaaatgatcttgattttagccctttgtcttcttttcagcgtgaagaaaacctttgcagccctaggaaggacgagtactggcgcggagcgaatttgacattcgtgagcaccagcacgcaggactgacaccgaatgcgagggtttgtctacacgctggagccggcttttttgtgttcttcttttccttagtaaggtataaattgacccttcaacttatttttatacttttctaacctggcaaattttctacacgtaataagagagcataaggtgacgatgatcaacaaaatttcatgcgtttctcctctattatcaatcactttcttcatgcctatccccccattattgatctatttctcctacactacctcattcatatgttatcattttagacacatactggaaatcatttcaaacgttgagacactcatatttgtacaatgataaactgcaagaaagaagtgacattacttatgcttcagatatattctgccaagttattatttgaatccatctcatcaccaagcaatatgcctgataaaatatttgaagaacgaatcattttggtgcgagccaaaaaccatcgtaaagtaaaagatatcgtccaaaaaagctttccagaagaaacctttgataatgctgaaggtggacaaacgaccataaaattagcagccatattagatgtctttgagcttgtagatcacttaaaacaagaatcgctgcatttaagtgaggtgtacagccgccaccttatttttgataaagaaacttcggcgaaagaagccatcgaggcttattctttagacaaataaaagaagccggctgatgagccggctttttaatagcgctgaaataactctggatttttcggaacgttttctaaatatacaatctttcctttgtcgtctagttctgcaatatcaattccttctgctgtatacacacgaccatccgaaagttttccacaaacggcccagttagtttcatacttgccatcttctctttttttccatccatcccacatatgcttgatgtcttcatgcacgtggaaaaatgtgtttaaaaactgtgtaaacgcttggataccaggcttctctgcaccatttaagacaatcatgacatcgtcagaaaacaatgcgagcaattcatccatttgctcctgcccttttccagcttcatcgtagcggcgaaaatacgtatcgagcacttccattgttcattctcctttatttacctatcatttcgataaaaatcgaacaatttgattgtacacaattgtttctcacctgtctattttcaccgaaatcagaaaagacatgaattgaatcaatccatgtctcttacaaattaaaaagatgctttttctgatgcaacaagtgcttccaattctgctgctgcttttttaggatcagcgctctggctaatggcgctgatgatgctgatgccatctgcccctgcttgtatgactggtgctgcattgccatatgtgatacccccaatgccaacaatcggaatatgaagaccatgatgacgtacttcagtgatcaatgatactccttggacactacgtgtatcctttttcgtttctgttggataaactggacccatgccgacataatctgcgccgtccttcatggcttgtttcacttcatctaagttatgcgtagacacacctaatattttattcccgattttttgtctgacgtcttctgcatttgtatcttcctggccaacatgtacgccatctgcatcaagatctatcgctagctgcacatcatcattcacaataaaaggaacattcgcttcttggcaaagtacttgaagttggcgagccaattgtttcttctcttctccttgcaaggctccctcgcccttttctcgaaattgaaacatggtgattccgccttgaatcgcctctttcaaaacatcaagcggctgccggcttgtattctctgttcccataataaaataaaccgataattgctgtttgatttgctgttgatcagcctttgtcatgtgacattccccctattttccccagcgttaacacatcatcgccagttgtgtgtgtaagtgcattgagcaattccatttgaaacgtacccggccctttattctgcgtgtactgagctgccttttcagctgcgacaccatagaacaatagagcagctgccgacgcgtgaagcggcctttcacctgctgcacaaaatgccccgatgacagacgtcagtaaacagcctgttcccgtcaccttggtgagccattcatgtccattataaatagacaacacgtcctctccatctgacaccacatcgactttcccagtgatcaccacaacggtttgaagtgtccttgctgcttgtttgactagtgccgatacatctccgttcgctgctttcgcatccacgccttttgactcccagccatctacttcaagtaaatgagcaatttctgcagcattccctctgacaacggtcatgtttacttgctctaacagctgttttgccgctttcattcggaacgcagtcgcaccgacgccgacagggtctaatagaacaggtatcccctttttattggcagattgtccagccagaatcatggcctccaccgtctccttggtcagcgtaccaatattcagcacaagcgcatcggctaattgcgccatttcagccacttcttctttggcatttgccatgactggcgaagcgcctaaagcaagcagaccatttgctgtaaagttcgtcacgacttgattggtgatattatgaacaagtggatttccctctcgaaccttctccaataaatgagatgcgctgcttgttttcatccgtatcgtcctcccttttactctgctccccatacataggatttcgtatgctttaaccattctcttgccgcaaacgacaaatagcggtctttacgccaaatgacacctaaatgccatgggattgacgtatttaaggaaatgactttcaccttttctggatcaagatcacggcagatccgctcaggcagaaggccaattcccaagttctcggctaccatctcactaatgaaatcccattgagacgtttcataaatgacattgggacggaagcccgcattcatacattcattcaatatccggctatgcagaacaaagtcttctcgaaagaaaataaaagactcttcctttaaatcagctaaatcaaccttatctcgacctgccatcggatgtgatggatgcgtcacgagcttcatgtcctctttaataatggtgtatgtatgaaagattttatcatttgcaggcagaacaatgacaccaatatctaatgaaccatcttcgaccccttcctctactttaatagagccgtgctccactaattgaaaggtgacatcaggatattgctggcgaaattctcccataacgttcgggaaaaaactcgatccaatcatcggtggcagcccgatgcgaatatgcccttttttgacattcattaaatcatttagctcgctcgttaaattttgaaatgattgtgtgatttcactcgcctgggtatacatcgtttgtccagcatctgtcatttcaacctgccgaccattccgataaaacaactgcacccccagctcatcctcgagatttttgaccatcttggaaatggtaggctgcgacacataaagagattgtgatgcttttgtgaagctttttaacctcgccacttctaagaaatatgttaaatgtctaatgtccacatgactcacccttcctatagacaaaaggaatactaattattcgatatatgtattttacctataactgaacgtgctgtacactttaaagtaagcgaatcaattggaacgttgtcatgtttttgtgaaacagtgaacaatttatatagaaaaaggagtgaacagaaagtgaaattgctcaaaacgccgctgattgctgtccttcagattatggctttgtttgtttttgcgaaattgatgaatgtgctcgcggcctttttgcatttaagaattccgggcacgattttaggcattctggtcattttcttattacttcattttaaaattattcaattaaaatggattgaacttggtgccgtatggctactcggagaactgctgctattctttattccgtcagccgttggtgtcattgattatggaacattgctttctcaatctggtacaagtattgtccttgtcgtcttactgagtacctttgtcgtcatgctctcgactggtatcatgacgcaaatgatcgcgaaaagaaaggagcgaaaaaagctatgttagttggcgcactatttctgatcttaacggttcttttatatctcggatcaaaagcgatatataaacgacacccgaaggtttatgtatccccattacttgtgacaccgcttgtccttgtcgtctttctgttaatcgtcaacattccttacgacgcatacaatcaaggcgggaaatggctgacgaatatgcttcagcctgcgactgttgcttttgccattcccctctataagtattttcacattctgaagaagcatgcagtggaaattattttgaatgtggcttgcggttctgtcattgcgatcctatctacagcatttatcgcgaagttgtttcatttggatacaggcctaattgaaagtcttgtgccaaggtcagtcacaacaccagtagcgatgagtgtgtcagaaatgattggcgggatgccgtccgttacggcagtattcgtcattttaaccgcactgtttgggtcaatcatcggtccaatgatcattcgttatttccgtattgataatgacattgccatgggcgtcctgcttggtacaggtgcacacggggcaggaacatcgaaggcatttgaaatgagctccgtctcagggacgatctcaagtgtatccatgattatttcagccattattactttatgtgcagcgcctatcctcatgtcgtttgccttataaaaaaagccatttcctttaacggaaaatggcttttttcttatgtttgtatgaagacaacctttaaataatttccttctggataattcttcgtcgtacggaaatcctcaggaagggtatattcttcaaggatacgatagctttgccctgattctttaaaggcctgcgcaataaatcctttgaattttttcataccaaatgcactgctattcgttgatgccacaatgacgccgttctcagctgtgatttggatggcttcttttaatagcttcttataatccttcgctgcactgaatgtgtgcttttttgtgcgtgcaaaggaaggcgggtctaagatgacaaggtcataggtccatccttttttcgcagcaaacggaaagtacttaaagacgtccatgactttaatatcctgcccgtccacatctatatcgttgacttcaaactgttcagatgtttttttcaaactgcggtttgcgacatctacacttgtcgtccggctcgctccgccaagcgctgctgccacggagaatgcacctgtgtaagaaaatgtattgagtacggtctttccttttgcataacgatctcgaattgcttttctcacatgacgttgatcaagaaaaatgcctgtcatcgcaccatcatttaaataaaccgctacattcatgccattttctttcacgatgagagggaattcacctttctctccctttacaaaatcatcatcttctatatactgtcccgacgtatcaaatcgtttcttttcataaatgcctttatagtctggatatacatgctcaagtgcagccaatacttccgccttgaatgtatacactccttcgctataccactggatgagatagaaaccgtcataatgatcaatcgtgaacccgcctatgccatctccctctccgttgaacacacggaaagcagtcgtctgtgcatcacgaaataaatgcgttctgcttttcgctgcctgctcaagcttggagacaaaaaaggtatggtctattttttcgttggcatcaaaggtgagtacccagccgatccctttattttgcacaccataatatccttttcctaaaaaggcgcctcgctcatccacccattcaatcagctcgccttctttcacactgcttacatgcgatacagcatctttagaaatgagtggatatccctttttcacttgttctgcaaatgtttgttttaatgagatttttttcatttgtgtcatccttatcctaaattgactctctctatcctatcatatgaatgtatacgttacttctattatgataagatgaggagaaaaatatcaacacaccatagaggaggctctttttttgacgacattacgattagatcatacaggtattatggtttcaaatattgatacgtccattgatttttatgaaaaggtcgtgggcatgaaattaaaggatcgcatcactcatacaaacggagtcattgagcttgcatttctcggctttaaagatgaggcagaaacggaaattgagctcatccaagggtacagcagcgacctgccatctgaaggaaaggttcaccatcttgcctttacaacagacaatattcatgctgaattcaatcgtattcaaaagctgcaaattgaattgattgatgaagaaattacgacgctgccaaatggatactgctacttctttttcagagggccagaccaagaatggatcgaattcttccagcgctaatatttcctaggaaatgaggctggctatgccccataaaagaaaaagagtaagagcatccatatgctcttactctttttttataataccttactaagaaatgattttgtacgctcatgctgcgggtttccaaagagagcttccggtttgtcttcttcgacaatatatccgccatccataaagatcacgcggtctcccacctctctcgcaaagcccatttcatgtgtgaccacaatcattgtcatgccttcgacggctaattgtttcatgactgctaatacatccccaacgacttcaggatcaagagcagatgtcggttcatcgaataataacactttcgggtccattgccaaggctcttgcgatggcgacacgctgtttttgtccaccagataattggttcgggtagcttttggctttgtcttttaagccgaccttttcaagcaggtccattgctttatcgactgccgccttcttgtctgtgccttttaccttcatcggcgcgatcgtgatgttttctaaaacggttttatgaggaaataaattaaagtgctgaaacaccatccccacttcttgacgtaccttattgatattcacctttggatctgtaatcgtatgtccgtggacaacgacttcaccagctgtaatatcttctaatttattgagacatcttagaaacgtgcttttgcccgatccagaaggaccaatcacacacactacttccttttcttcgatgactgcattaatatcctttaacacttcgtgatcgccaaaggatttctttaaatttttcaccgtaatcatactcatttgatatcaaatctcctttctgcgtagctagccagtagagaaagtaaataaatgatcacgaaataaatgattccgacaatgagccagacattcaaaggatcaaatgttgccgatgcctgtacttgtcctcgctgcataatatcggcaattccgataatagataagagagatgtatccttcaagctgatgatggcttggtttgtaattgctggaagcatgcggcggaatgcctgtggaaggacgataaagcgcatgttttgcccccctgtaaagcctaaagagcgcgcagcttctgtttgtcctttatcaatggactgaatccctgcacgaataatttctgagaaataagcccctgcattaattgctactgtaataatccctgccggcactcgatcaagcgaaatgaattcaagtgtattcaaaccaaaataaatgaagaatagctgtacgataaatggtgtgcctcgaatggcattgacaaagacaagtgcgatgaaatttaagattttaaaaggtgatagacggaataatgccactattaaaccgatgataaatcctaaaatgatggcaacaacaaagatatataaagtggtttgcaaaccgtccattaaatacgggaatgcattaataatcgtgtccatgtttctccctccctaattcacatacggcgcatcataaagaaagcgcgctcggaacgcgcctcgcttgtattatgacttcaaatatttatcaataattttgtcatattcaccatttttctttaggttctctagacctttattgatctttttcaataggtcttggtttttccccttcatcacagagataccatactggtctccatttaatcgatctccaactgttttcaattttaaatcttgctgtgcaattgcatacgtaatgacaggataatcctcaattaaggcatctgcatttccgtttgaaacttcttggaacatcgatgggctgtcattaaattgaaccacttcatacccatatttatctgcgttatctgatgcaaattttgcacctgtcgtcccatttttaacagctagctttttcccctttaaatcatcaattgatttgatgctgctgtcctttttcacaacaactgtcaatccagcgtcgaagtacggatctgagaaatctaccttcttcttacgctcatctgtaatgctcattccgcccatccctacatcaagctgacctgcctgcattgccggaataatgcctgagaagtccatcgcttcaagtttcactttgaagtcttggtctttcgcgatggcattaatcagatcaacgtcgattccttccgttttaccgcccttttcaaattcaaatggcggatatgttacatctatcccaattttatatgtgtctttgccttctcccgaaccgctgtccgattttgatccacaggctgccatgacgagcacaactatgagtcccatgatcagtaacatcgattttttcataaaacacgccccctattgtcagttttgtctaaatattcgcaatacaaataatactataccacgctaaagctatagtgtgtgatgttttttatcaataccaaagatccatacaatcctagatcaatagtctctttaaattttacttttttgcgaataactcattttattctaaaagaagagcgattcacaatcataatgtgagataatcttacataaaacgagatatcaccttgataaccgccgttttttctaatatacaaaaacagacacttgaatgatcttcttctctctattgatatcgtaatatatcttctctaaaaccctctttttacctaaaaatatgtaagcgcatacaaatagacatctgatccctatttctttcacaaatggttgaatttacatcaaaaaacatgttttacaaattgcgagagagcgcttaaaatataagaagatactgaatatggaaagtgaattcagatgaacggaaatcgaacgagatggatagatgaagaaaggaggatataaattggaagaaacaggtgttttgtcgtccgttgatgtagcgaatatgttaaatgactggtatgtcatgatgaaaaaaagagaaatacaaggtgcgatcaagctaaaagaagaaatccttcaagcgtttgatcgcatggaagagaatcaagacgtcttactttactatcaattgctagagtaccgttttaaggatctcattgaagatacagcttcgctggatcatagtctttttgttgatgaaaatgcaatccgtacagatgacatgctcagctactatttctatttctttaaagggatgtatgaaatgcgcagaggcaatcaggatacagcatttcaccttttaaaattggcagaggataaattagatctcgtccacgatgacattgaaaaagcagaattttattataaaacagggtgtctttactataatataagatccacgctcctctccatacaccacttgaaaatggcttcatctatttatgacgcagatccatgttatgtgaaaaaatcaatcagctgtcaaatgatgctcgctttgaattatgctgatcaatcaaaatatgatgaggcagagtcattatttaaaaaagtgattcattcactagaacaaatggaagatccagatttgcttggtcatgcgtattgcaatgcagcttttattaaaagtcttagaaatgaatacaatgaagctgtgccgctcctagaaaaagctttattaattgagacatttgaaacgtcttctccaggcggctacttactggccatgtatgcctacacaaaagcactattcaagctgaaaaagcctggtttgttccactattatgtacaggtttcacttcaaaaagcagaaaatttaaaacaacgaaacatttcacttaaattatctattttagaaacacttatgcttcagcaagacaacatgatagagcaaatcaagtcttattgtaatcaattagaatccatgaattttcttgtcgatcttgaagccatctgtcaggatgcagctgcttacttaacagatcttggacttcatgaagaatccacttatttctcgaacaaggcgttgtccttaaaaacagatatggagtgatgtaagatgaaaaaatggtttatcacaagtgcgattttgacactcttgataacaggtgtttctattggcgtttccactcaaaaagacagccaatctgcacaatctcaagatatcattcaaaagagagaccgcggcaccaatccttaaagatgaaaaaaagcagctgtgaatatcgcagctgctcttttttatgcgtcaatcgatttctcgtttaatattttgcattttttcatctaagtaatgggctatatcagccgcttccttcagttcatcggttagctgatgagggacatcgttttgcagtttataatagattttatgctcaagactcgcccaaaaatccatcgctatggtccgcacctgaatctcaacctttacatgctccacacgattcgttaagtacacagggatctccacaattaaatgaagacttctgtagccatttggttttggatgctgaatataatccttcacttcaaggattttcagatcctccctttgcctcaatacatccataatattatagatatcttgaataaaggagcagatgatacggacacctgcgatatcatgaatatactccttggcacattgtgttgtgatgtcgcatccttttcttgctaatttatttacaatgctttcaaaggatttgatccgtgattttgtatgctctattggattgtgcccatggattaaattatattcctggctgatgattgaaaacttcgtatccatttcatctaatgcaaatttatatactaataattcatttttccagtcttccatgacgtttttcaaatcttctacatgagttgctgacatattcatttctatttgtcatctccttttgggaaacggtggctgcaccgctttccgtttactagacggagatgagactcgaaaggttttaaaaaatacgtcgtcagcctcgctgtttgtaatacgtcaacgccagcgcaagcgcgagtacagagcctttcacaatatccatcgcgtaataagggacagacatcatcacaagcccattttgcaaaattccgatgagtacagccccaataaaagtaccaaatgcatttggttttcctgctcccatgacggaaaaaccgataaaagctgccgctacgccatccattaaataaggtgtgcccgcatttatttccgctgtcatcacccttgatgccagcacaataccaccgattgctgcaaataaagccgagagcagatatgctgcgattttatatttattcacatgaataccggacaatcgagccgcttccttatttcctccaatgatgtacataaatcgtccgtgctttgtgtaggtcatgaaaacatgtgcaaatagcacaatgactgccattaaaagaatgatatatggcacctgtccaattttgctgaaaaaggcggggattgtacccgttgagaatgtaccgtcaggcagcaccatgttttcagaaatagtcgcccctttcgtatacgtttgagccaaaccttgaatgataaacatcatggctaatgtcatgagcatatctggaattttcattttgacaatcatcaaggcattgagtaaaccaacaataagagcagccgctagcgcagaaaggatcgcaatcagcgggttttgcgaaaaccacacaaacatagaaatcacgattgcattcgataacgttgcaattgatccgactgatagatcaaagccgttgactgccaatgagatggtaagacccaccgcaataatggtcacaatggagatagaccgtaaaatattgatgatattccctgtttgtaaaaatgctggattcgatgccgcaaataccacaatcaataaagcaatggttaagatcgtgccatatcgataaaagaaatcaaatagatgaaaggatggccgctgttttttcgtttgctgtacaggggctggaatttgttgttcactcatgattgtcctcctgttgaatgatataaaagctcttcctcagtcgttggagccgtcatttcccgggcaatgctgccatcatacagcacataaacgcggtctgcgatacctgcaatctccgatagctcacttgacgcataaatcacagatttcccgcgggcggcaagctctgcaatcagcgtgaaaatatcttttttcgctccaacatctactcctttagttggttcatcaaagagatagacatccgcttcagcaagcagccattttccgatggcaatcttctgttgatttccaccggatagatgcttcaccttcgcttcaagagatggggttttgacaccaagtcgtttgacgatttcgtctgctttccgctgttccttcgaacgatgtaagaagctgaacacgcttgagaatgaacgaagacttgcggccgttaagttccagcccacgctctcttccgttagaatcccttcctttctccgttcttctggcacaagggccattccagctctcacggcttgatgaggcgatgtgatgcgaacgatttgatcatgaagctttacagtccccgtctttttttctgaggcgccgaaaagagctttacacaattctgtttttccagcaccgacaaggcctgcaattccgagaatttctccctttttcacatgaagatgaatgttgcgtaatttatgctggtcatttagctgcttcacttcaaggacaataggtgcatccttcaaaggtgtacggagcggaaattgctcctctaatggcgcacctagcatttcttcaatgatctgctgcggatttgtattttgaacaagatgagctgcgacatcggttccatttcgcatcactgttagttcatcacagatggtgaaaatttcaggcatgcgatgagagataaacacaataccagttccattctgtttcagccgatcaatcattgaaaataacttgtttgtttctgtatgacttagcggagctgttggttcatctaagattaaaatgctgcatttgattgaaacggctttggcgataagcaccatctgtttttccgcaagggttagatcactcacaaggcgttttgtggagatgtcgatgtccagttcttttaatcgttgcgctgccttacggtgcagctctttccagtcgacaaatgtttttttctcaatctgatgcatcatcatattctcaccaacacttaagtagggaacgagagctgtatccacttcttgatgaaccgtctgcacaccatatgaggccgcatcctttggggtttgaatcgatgccgcctgaccattgatttggatgcttccttcatagtgcgaatgagcgccagagagaactttcattaacgtggacttcccagcaccatttgctccaatcagtgcatgaactgtccctttttttaatgtgaaattcacttgatctaacgcttttactcctgggaattcaatcgaaatatgtttcatacaaactagcggcgaagtcatagatgtcctccttctcatgatcatcatctgaaaaacgaaacaccctctatagaagagagtgcacggtgtttattttgtataatgcttcttcaaggtcttcatccaatcttcttcaaaggcagtcgatgagccgaaccccttcacttcgtccgcaagattgaccatattgatggcttttcctgattgttgaagctgtttttgtgagatgagagaggcctcaaggtcataggaagacggggttttctcacccgctattttcttcgcaagaattctcacgtcaactgcgccaataagcttcggatcaaccgctgctgtgtacttccatggactgtcttttgctgtcatttcttgaagatcagcatttgatacatcaatcccataaatcttcacttctgttcttcctgcttcctttagcgctcttgctgcgccaatggcaaaggcatcccacgtggcaaaaatagcatcaagtttaccctttggatatttattcagcatcgctgccactgcattttgtgtttgaacagacgtatcagaggaggcaataccaaagcggtcaagttccttgatccctgaatgttgtttgagcgtttcttgatagaccttattccgtctcaccattggcgggaatccatctacccagaggtacgcaatatttgcttttcctttaaaatcagacacgagtgcatctagtgatttttccgctaattgttcgtcatcttgagacgtcactgtgactcctttgatgtccttcagcttaggatttgaatcgaacgctacgactggaatgcccttcgctgtgatctttttcacatcagcgacggtcgcctcgtcatccccatgagagatgataaagccatcataattttcttccagcgcctgagagatcgcgtcatggaacttcgctgtatctccatttgcggtgtagacatctaccgtaaagccaagcgcttcaccttctgccttcgtcccagctaaaaactgtgctgtatgatcatctcctccgatttcacggatgactttaattttcgctccctgtccctttgcaaatcgcttcggtacattgtcaaaggagaccttttcgttcgcatttgcctttgagcctgcacttgatccagtgccgcagcctgttaataggacggtcaataccgttaataatataagacatgatgtaaaatacttacgcttcattgctgttcctcctcaagttgttttttatttttcacatcggaaaactaggtaaaaatgtgagaaaacgccagtaaactggtcttccatttgaaaaagagacgaaaaaaagcctctcttggaaagagaggcgtgatcaccgttgcatgaaacatgtatcgggaattcttcctctcttatctgtcaaagctgtcaaagctttgcaggaattagcaccaatttctatagtagaaacggttgccgggcgtcatagggccagtccctctgcctctcttgataagagatccgttatgaaattttgttttagttgaaatgtcttctttactttaatgtgatgtcacatcaatgtcaatgatttttttgaaaatttaaaacaataagcttatggctcagacatgcttaacttccgatgattttcttagcaggtgatgatttcttcaggcgaaaatcatattttttctcattcacaaattgtggattgaggtgtgctgatcctttatcttggccgcttttagagagatacgttttgtagccttccatccatttcccgcgccatacccactgtgatgccttcgcacctttgcggtcatcatatacgttcttttcgaaggtattcttttggttcactccataaagattcacaactaagtaatgcgaggcactcgctgtcatgatattgctcttgatacgattgttcacggcttgatattgcatcaacaattgaccgccttctaagccggctgtgtcatttttgtataaaatattatgtgaaatcgtcgtatttattgttccgcctcgctttttatcataaccgccaattgaaatgcctgtataacggttcaaatacacttgattgtgttcaattcgaatacgatctgccatttttcctttatgttcacttgtgacttcaatcccaaggtcattgtgatgtgtgatgttatgatcaatcacaatgtccttcccgccatcgacataaatgccaccagcggagatgtctttgccataggctggatttcctacactcgtaatctcatacactttgtttcttgatacaacaccatttctgacttgatcgtactttttagaaggtgctacgttttcaaaaccaattaaatcaatccctatattatcagtatggcggacggtgttatgtgtcacacggaacttattgacgttcccattgagcacaagcgcttcactgaagccaagctttaatttttcaacagtgtttcctttgatttcaatgtcttcaatagccgcaggagcttttgttccatagaccgcaataccgtgcgcattcccatttttgtgtgtcgtctgaatatcatacactcggttgttgagcagtttgacgcctttcccgcttcctttgataaaaataccgactggagtcagatcttccttatttgtcttgagatgtcccaccgtcagccctttgagggtaatgtaacttttttgatcgatcgtgacaagaccaccatctgcttgatttccttttagtgaagccccgctaatgacaggtttttcttttccgtaagcttgaaagataacaggtgctttctttgtacctgaatggcggacaatcaatttttctttgtatgtaccgcctctcacgtatatagttgccccggcttttgccatacttgatgcctttttcagcgtgcgaaaaggtttttgcttcgttcctgggtttttatcgtttccgtttgtcgctacgtaataggctgtgctttgcttagcacccgccttctctgtcatcgcttgacagccgaagctgatcacgatcatgaataaaataaggaaaatgcctggtatcgctcgtttcatcttgttgtttgctcctttcgcttctcttctttctttatcggttaaaaaaaagaggattaaaatatgagaatgccccttgcaatgtactggtcaaaaggtgtatggttgaaagaatatcttacaggaaatttatccgcttttaaattgtcagattaatcagttaataatgtatttggattttatttctttattaaaaaggggtgacatgaggcagactgacggcagagagaaggaaagcgctttaacagatttttcttgtctgaattccagaaaacctattgctaatattttgggaaggtatagaatagaatcataattatttcatattattagaattttcaaataatcaaacagcaaggagatttacgatgccaaaacaacccatccgcgttgaacttagttcaacaaaaaaaccaaaacctcaatctgatcaacttgaattcggaaaaatcttcacagatcacatgtttgtgatggattattccattgatcaaggctggtatgatccaagaattatcccttatcaagccattccaatggacccagcttcgatggtctaccattatgggcaatctgtttttgaaggcttgaaggcttatgtttctgaagatcagaaaattctcttattccgtccggaaaagaatatggaacgcttaaacagatccaatgaccgcctgtgcatcccacaaattgatacagaaacggttttagagggcttaaatgaactcattcgcattgataaggattgggtacctgatgcagagggcacttccttgtatatccgtccattcattatttccactgaaccatatttaggcgttgcgccgtcaagcacatataagctgcttattatcctatctccagtgggatcttactataaagaaggcatccatccggtcaaaattgccgttgaaaacgaattcgtccgtgccgttaaaggcggaacaggtaatgccaaaacagctggaaactacgcctcaagcctcaaggcacagcaagttgctgaaaccaaaggtttttcacaagttctttggcttgatggagttgagaaaaagtacattgaagaagtcgggagtatgaatatcttctttaaaatcaatggcgaaatcgtgacgcctgaattgaacggcagcattctagaaggcatcacacgtaactctgtacttgagctattaaaacactggggaattccagtgacagagcgtaaaatttcgattgatgagttaattgaagcacatcaatcaggcgagcttgaagaaatctttggaactggaacggcagccgtcatctctcctgtcggggaattaatttatcacgatcagccatatgtgattcaagatggtcaaacaggtgaagtatcgaagaaattgtatgaggccattacgggtattcaaaaaggaacacaaccagatatcttcggctggacagtagaagtcgactcggtcgtcaaacaagcttaagcatgtaaaagaacctttcattcatgaagggttctttttttgtttatttacctttctaatataccttataatggtaatcacacatataaggagtgatggtatgttttttacttatctactagcgttctttgggatttgcatcggatcgatgatcatcgctacaggtttcgacgattcaccgttccacacccgttttctatttaagtttctcggaatttctatcctcgttctttctattacttttgtaaaggtgagacgaaaaaggttacgcagcaaaaaggcgaaatagacttagatgtccagtcagcctcccatcaaatcgtgcaccaaaataagaccgatacccccacaatcgcccctgcatatatccactgtttccctttgatgctccgctttctttcaatcagtaaaaagatctctggtaaaaagacgatgatgatttctatgaaaaagacaagataataaacaaacggcatcggctgaaaatcaaagtctctttcatctccaccaatagttgcgaaatacatcaacaggttggttactggaatggtaaaacaaacgagcaggcgaagaacatacatccacacatactgtctatgacgaataagaccaataaatgaagcgatgatgccatacaaaaacaagaccactgtgccataactcaacagaggttgaacgacaaaaccgtaaagcattaaaccaattgcaaccatactcaaaccgtcccttctttgaagccatacatgttgttttttactatcatacacttctttcttgaatttccatatggggccatgataaaaaaacgaccccataaaggggccattttgttttatgctttgactgatttgaagaattgcggtaaatattcacgatgcgcttcgagcatttcatctaaaatttgctttgcaatttcgtcagatgggacaagcggattgatcgtcattgctacaagagccgtctcgtaatctcctgtgactgccgcttctgctgccacacgctcgaatgatttgatttgttgaacgagccctctcacagccacaggcagatcacccgtcgcaattggttttggtccgtccttcgtaatgatacagttcacttcaaccgctgaatcagccggaatgctggcaatcgcccctctgtttactgtattgactggttggatgtcatgcttatcattatagatggagctgattaagttacatgccgcatcactgtaatatgccccgcctcttttttcgagctgcggtggtttaatcgataaatcaggatctttatagagctcaaataattcgtgctcaacctgctggactacctctgctcttgttcctttttcttgggctgccttttgctcttcttccagcatatcttttgttttatagtaatagcggtgatatggacatgggatgacccctaagcctttcacaaaagaaggttcccagtttttcgcttcaatgttcttcatagaccactgactattcggatttcctaattcttcgagcacttgatccataatgctgaccccgtctaaatacacatctaatccatagaccatgtgattgaggcctgcaaactgtacctcgatccgttcaacatttacatcaagcgccttggcaatccccattttcatcccaattgggacattacatagtccgactactttttttagattcgtgtagcgcagcacagcttctgtgaccatgccggctggatttgtaaagttcacaagccatgcatctggacaaagctcttccatatccttcacgatgtctaaaatgactgggatggttcgaagacctttaaataagccgcctggtccgttcgtttcctgaccgatgacaccatatttaagcgggattctctcatcctttgcccgtgcttccagcagtcctacacgaaattgtgttgtcacaaaatctgcgtccttcagggcttccctgcggtcgagtgtcaggtgtacctcaatcggcagcccggctttttcgaccatgcgtttcgcgagagcacccacgatgtttaacttttcctgacccgcttcaatatccacgagccataattcctttacaggcaattcatgatatcgtttgataaatccttcgacaagctcaggcgtatagctcgatcctccgcctattgtgacaattttgattccatctttcatgaattgacacctccaagttgcttcattttttcatggagctcgatgatttccgccgcaagctccttgacagtcattgcgttcatgagatgatcctgtgcatggatcattaagagactgatgtcggtcttttctcctctaatttctccttggatcagctctgtctgtgcgtgatgcgcctcatttaacgcgtcttgtgcttcctgcaatttttgcttcgcctcatcaaagtttccttcctttgcacatgtaatggcctccatcgcggagcttctgccattcccgccgtgtaagatgagttgaaacacaatttgttccatttccatcggccgcatcccccttgttccctctattacatgctgacgacattttcatcagttgttgcttttgtttctagttcactttcttcttttaatttctgcttatcccacattctaaagaatgggtagtataaagcgaatgacaacgccaggttaatcagctgcatgacagcgccagagattttgcctcctgtggcgagatagcctgaaatgatagggggcatcgtccatggaactgcaatccccgccggttttgccacaagccctgtgctcattccgatatatgtggtaatgatcatcatgattggcgtaaggataaacggaatcaaaagcattgggttcatgacaatcggcattccaaaaatgatcggttcgttgatgttaaagatggctggcccaatggcaagtcggccaagctgtttcatttgtttacttctggcacgtaagatcatcgtcagcaccaaggcaagcgttgcaccgcttccgccgacattgatgaagatttcaaagaactgcgctgtgaagatatttggcagcacttctcctgcttggaatgcaagacggttctcatccatcgcaccgagccaaattggtcccatgacgccgccgacaatggttgctccgtgaataccacaagcccagaggagcatttgcacgcctatggcgacaatacttccgcctaagcttccaccaagaatggaaagcggtgtgccaattaagaccgtgataatattatgaatactttcaaatggtgtcatctcaatcaaaagtctagcgacccagatcagtgtgatgaccacaaaacctggaataagtgcgataaacgatttactcactgctggcggtacaccatcaggcatcttaatgacgatattccgctggacaatgaatcggtaaatttcagttgaaagcatggcaataatcatggcaacgaataaccctttactgcccatcaatgtgactggaattcctccacctactaggatggcttctgttgagccctcaggtgtaaaaggaacttgatatggtgtcgccaaaaggaatgctgcaacagcgattgcaccagatgatagggcatccactgcatacttttcagcaagcctgtaggcaatcccgaaagttgcaacaagtgccataatgtcaaaggttgcattaacaggataggataatttcgtggcccattctgctccgaagatacttgccataaaatcgctgtatcctgggatcggaaggttggctaaaatgagaaacagtgaaccgacaataatgagaggcatggttaaaacaattccgtcacgcaatgcttgtaaatgtctttgagcggcaatcttccctgcaaacggcatgaccttctcttctagaaatcggttgaatccattcatcccttccgccccctttatccgttcactaactgttcagcagattttaaaacctcagccccattacatacgccataatgcacggtattgatgacgtcgactggaatccctttttcttctccgagctttttcatttgtggtaataaatatcgaacctgtggtcctaataaaagcacatcggcttgatcaatatgattttttgctgaatctccagatactgcccaaatacgatagtcttttccttgttcttgtgcgcttttctccatttttgtgactagtaagcttgttgacatacctgctgcacaaaccaataagatgttcatgtgtaaacgcccccttttgaaagtgtgtagcttttctttacacattcatcatattatgaaaccgctttcataaacacctatactttttcctttaggaagcggaaaaagttaagatcacacagttaattcttgtacgaaggggtctttttatacatgatatcgagcatgtcttcaaatgtatcacaggcgatgaggtgctgaatgaatttcacattgtgcacaagctcgcccagcagacggtacatcccttttaaatcttttgcattctctttttcgacacaaagcaagcagacaaattgaacttttttctctccccatatgatcggtttttctaatgtacatatcgcccaaaacgtctcttctgtcagcggcatcatagagtgcggaatggctgtataatgcccaaaggatgtgggagcagcctcttctctttccatcacagaagatgtaagctctgctgatgctaagcccatgtcgatgactttttccgtgagaaaggtgatgacctcttcctttgtttgaaaggcgcgttttgtaaaaaccaattcctttttcatatattgagaggccaatgtcactcttgtttcactcgtcagggcttcttcaattttcaaaaagtcgccgcctcccaaaatcgtattcacttgtatgacgggaatcggtatatccatctgaatcgggaccgttgtaataatcaaatcaagcgcatgtaaagagacatgcggaagcgaataaagctctgctgtgcctaaaatggtcagcttcgacccaaattgtgaccgcagacgatcttgaagcagtcttgcacttcctgcaccagacgcacagacgatgagacatcgcttcggtggaatctccatctttctccgttctaaagccgcaccaaaatgaagcgccatatatccgatttcattctcatgaatacatagacccgtttcttcttcaatcacccggctggcgataattcctgcttcaaaggcaagtggataccccgcctttatttcatccagcatcggatttcttaagttcatcccatatttacaccgggtcatggctggctttaagtgcagactgagcccaatcagcaattccgcatctcccgctaaattcagctgcaatttttggtcaatggctttcagcatgagctgaacaagacggctcgtgtcatcatccacaatttgtttttgaccgctcgatgaaaaggactgtaccattttggctgttcctaataaatgaatggcgatatagacgatttcctcttgtggaaaagaaacgtccagcagtccttcaaggcattccactatttttttagcgaccttgtattcctttgcctgtggaatctcattgatttcctctggcaagacagatacatagttcccgtgcctaatccgcttgcaggcaatcgcaacatgaacgattaaattattcatgcaaatgtctgatagattcattctttctttattgatataatcaatgattgttttctgaatcaattccaattcatgtttcggcaaaatggtcactgctgtgttcagcatcgtttggtaagatcgccgttcactgaatagatattctgacatacaataacggattttcatctccgatcctttgagcctgcagcctttattcggctttgcttctagcttcagatcaaaaggctcaagcttgcgtttgacccatttcatatcgttactcatcgtcgatttactaataaacagctgttcctgtaagtcttccagtttcacataagactctgcgagaaggagcttttttaaaataaaccgaacacgctcctccggcagaacagccagcggctcttcctgttcgacctcttctttcataaaacggcgaaaggcattctcatcgttgatcaacagctcataaccagctcctcgaacagctattacagacgcttgataaggagcgaggcggtcgttcagttccttgatgtctgtacgaatggtgcggcttgtcacttgtaagctgacagaaagcgcagcgcttgtgagcgggttctccgctgccattaactgacttaaaatgtgcgccagtcttttactcagcatcagatcggcctccttatgtaagggtggagaatctgccttgtctggacaggttgtatacgcttgcagttctcttcattactcatattctactgaaaagaaataaaaattgccaactcatttatatgacaaacgcccctatttatacaacaaaccatttctaatgacctatgaatctttttgtaggaccgtttggaagaaatgaaaaaaaggcgctgcaccttcgtgtcatcgccttttttatgaagaggtcagctgcgtaaagacaaccaatcttttttcgtgagttcctgctgcatgatcaaatgtccctgtacatgtgattaaattgagattccgtgtaaaggcatacccgaaaaatgcatgtggcttttcttcacgtggataactttgcactttgatgacttcaaaagttcgcttttttcccgatgaggacgtaacgatcaccttatttcccttttttagctcctttagtcgataaaaaacagaaggtccccatttattatcaacatgaccattcatgacggcattccctttatctcctggttttggaccatctttaaaccaagctgtgttgtccgtattttttggaacgcccatactgccatccttagataaagtggttttctctacttttgctttgacatcaatcgctgagatcgcaatttcagctggaacaataccggacggttcgtcttttaacatgctttttgtatgagactgttttgcagcttggtttgttgtcattttttcaggagatgaggttgtttttgcagatgacgaatcatccattgtttgtgatgcgcagcccgtgatggtgagcagcatcagaagaccaaacacccatcttttcaaatcagtctgcctccttttaaagaaaggaacggcacaaatgtgcacgttcccctttagtttttacgagcttaatttgatgtcttgcggcgaataaggaagaacgcacccattgcaccaccggctaggatcaagctagcgattaatcccgcaaaggcttcatatgacatacctagaggaccggctgtacctcccatacctgttttaggcatttcattaggcatcttggatttgaacatttcaggatgctgatcaacaattgctgatgcgacatcctgtccaaccatgaacatatgaccgtacgcctctcgcactgttggataaagctgatcataatcgccattatggtatgacgtatatgttttgatcagttcatcaatatgcatttttaagccagcttctaaatctgctgccttcaagcgtccatctgtcgcttgatctaaaaatttcgcttgcttcattcgatacgcatctaagtttttcatagctttttctttcgcttctttgtctcctgatgcatccgctttgacataatcaactaaataaccgatatggcttgaccaaatgtctttaaattgttttcctgcatccttgccataaacagaggcaatcgcatctgataaatcatttgtgttttcgttcaaagctgccgctgcttgatcaaagtccttgctgccatcatttcctttttgcatagcaacgaccgcaagcgccaaatgctctgagaacaagtagtttaaatcttcacgaaggtctgcggctggtgtgtcgactgatttgtgatcaaatttcccaggaaattgatctgtgatcgcccacgatacgcctttgcctacttcaaacatatgatgaatagattttctaaccgtttcataggtcgtatcaaaatccttttcagtgtagctatcaaacgcttttaacagttcattgacgtgcatttttaaaccttcttctagttcgctagctttcaatctgccgtctgttgcttgatcgagcatatcggcttgtttcatgcgatattggtcaagctgcttcatggctttctttttacctgcttcatctttctttgccgttgcttgcacatagtcaacaaagtagccgatatgacttgaccaaatgtctttaaattgtttccctgctttttttccgtacacagaggcgatggcatccgataaatcatttgtgttgtcgtttagcgctgccgctgcttgatcaaaatctttactgccatcaattcccttttgcatcgtgatgactgctaaataagcgtgctctgaaaacagctggtctagagctgctcgaagatcggttgctttgtttgacacctcttgtgacgaagatgtcttctttgcctctccatgcatatgtccttcgtgtgcacttgcgctatgagctgccggaaatagtaatgctgcgctaagcgggatggttaaaatcgcttttttcatgttcatctgttattgcctcctctttccgtttgttatgtacttaacggagtgaggcatgacttggatcattcaaatctatcttttttttcattcattgcgcaattggtatgtatgcataaaaaaaagccggattatccggctgatacgttacgacgtttagatgctttccgctctttatatatttttctcaccactggataaatcacaggtgcccatttaaaaatttgtttcagccattttttcatttctcccgcgcctccttattgtcattcttacaaggaagattccccatcttgtcatgaaataaacaggtgcgggagagcaggagttaaatcacgccttgtgcgatcatcgcatctgccactttgcgaaatcctgcaatatttgctcctactattaagtttccagagtgtccatattcatcagctgtctctgtacactgacgataaatcgtctgcatcatttgtttcagctgatcatctacttcctcaaaagtccaagacattctcgcactattttgcgccatttccagtgctgagacacctaccccgccagcattcgccgcttttgccggcgcaaaaagaatatcattctgttcaaaaactttgactgcctttagagtagagggcatattggctccttctcctaccgcaatgacaccattttccacaagctgctgtgcctgcatctcagatatttcattttgcgttgcacatggaagcgcaatgtcacaaggaacagaccaaatttgttcgcaatcttcaatcaattcagcatgcgggtgaatgtctatgtatgccccaattcgttgattgcttccttccttcagctgtttcactgtttctaatgaaatgccttgtggatcataaatcgctccgcttgaatcactgcacgcaacgaccttaccgcctagctctatgaccttctccatcgcataaatagacacatttcctgaaccagacacaacaactgaacgtccttcaaattgaagtccatgcgcttttaacatttcttccataaagtacaccaatccatagcctgtcgcttcttttctcgctaagctgcctccaaatccagggctttttcctgtaagcacacctgcctcataagcaccacgcattttcttgtactgcccgaacatatagccaatttcgcgtgcccctacaccaatatcacctgctggtacatcttgatcaggtccaatatatcggctgagttcactcataaagctttggacgaaacgcatgatttctccatccgattttcctttaggatcaaaatctgatccaccttttcctccaccgatcggcataccagtcagtgcgtttttaaagatttgttcaaatcctaaaaacttaataatgcttgcattgacagatgggtggaaacgaatgcctcctttataaggaccgatggcactattgaattgaaccctaaatccccgattgacttgtactttcccctcatcgtctacccatggtacgcgaaataccacaagccgctcaggctcgatgagtcgttctaaaatgccttgtttttcatactctggatgctttgcaaaaacaggaacgagtgattctagaatttctcttacggcttgctgaaattcctcctcaccaggatttcgtttttccacctcttctaacacacggtcgatgtagctttgtgctgtttgtgctgctcgatctaaggtcaacatgtctcatctgcctcctttgtatatcttcacacatttatcctgttagattttctaacgcatattgagattaatttaacaccatttgtaaaaactgatcaatactgataacagatgaaaatgatgccgatttgagatggatcaagcagccgccgcaatcgtttttagaaagtatctcttacagaatgactattgagctagaaatcatgatttagacgttatatatcccgcactctttgacaattagatgaaccatgaatgatttctagttgatcttcaacacgaaaaaaaggcctaaagttttataggccgtctgctcaatcttttcggatcttctcctctttttttcgatcagggtacacgacacaaagccaatataaaatagaagacgatgggaagttaattaaaccgacaatgccccaaaaccacttataacgtcctcttttctttgcatccataaataaaagaaagccctgcgcaaatagtaacggcaatgcgcacaataagatgatcatctccgtctgactcataaggaagaccctcctttaatatgttgatattccttgatgccgacaacgacgcagagcggcacactcactacttgaagaagaatgaagatgataggcatatgggtgatggcagcgacaaatagtgccagaatggtcagactaatgagaacgtacgccagtacttcttgtttaaaacgccttttctcttgttccttcgcctgcttcagcatgatcatgacagcctgttcacttggttctttcacttcaatttgttcatctagctgctgtaactcttcctttaaacgttctgtgaattgatcttccttcactgagaccactcctttcgaattttctttaatccatgatgagccctcgacttcacagtgccttctctcatcccgagcattgaagcaatctctggataagtaaagccataataatagtgcaaaataatcggtgctctctcctcagccttcaattcgtttagagcatcccacatctcatgccatgtatagcccttttgctgaacctcccatttaaaacgacgtatcgtctcttgattcgcctttccttccctcaattgttcacgtttccttttcttctggtgatccaaaaattgtctagatgcaatggatatgagccatgttgaaaataaggaatctcctctaaatgaagagagtttcatgtacgctttcagcatcgtttcttgcatgatttcttctgcaagctcttgttgaagggtgagcttcattatataacggtaaagaaaggaataatgatgacgatatagggctgtaaatgcagcatcatccccttgttttgcccgctgaatcaataatgtctcttctgtctgctccaaacacacccctccttcctttttcttctcttattcatgagacgacacgtatgacgatatcgttcaaaatagactttatttttttagcttgttgtatttgaagcattgaataaccagttttttcttatgtaatgattatgacattccttcgtctctaacaaaatgatgcgttctgattttctatcaagcggagatgctctcccccataatcactaggtcatcccaatacctatcgtcaatgatccttgtctcatttagatgaaaataaaataatcatggccttagttctctagaaaatcatggaatacacagcgccaattcttagccgatgatacctttttgcatgctatgctcttcctacattccgaaaaaggcgatactggcgaagaaaggaggagcagtggaattgcagcttatttttggaaacgtttacattaaaacaaaaatgaatggagatgttgactttgaagaaaaaagttccaatgttagctggtgtgttagcggttggtctcgtgacttcattatttgcaccaaatggggaggcaaaagcggcagcaaagtatcccgaaagcccttctattatggccaattttaatcaacaaggattctccacattaaatggcggtacaacaggcggtgaaggcggtaaaactgtcacagtcaaaactggaaatgaactattggctgccctcaaaagtaaaggaacaaacgaaaaattaaaaattgttgtcgacgggacgataaccccttctaatacatctgccaataaaatcgatgtgaaagatacaaacaatgtctcgatcgtcggcaaaggcacgaaaggtgaatttaatggaattggcattaaagtatggcgtgccaataacattatcatccgcaacctgaaaatccatcacagcaacatcggtgacaaggatgccatcggaatcgaaggcgcttctaaaaacgtatgggtcgatcataatgaattgtacaatacattaaactctggtaaagatgattatgatggattatttgatgtgaaaaatgactccgactatattaccttctcatggaactatgttcatgacagctggaaaacgatgctcatgggcagctctgataacgacaactacaaccgaaaaatcacattccacaacaaccgttttgaaaacttgaattctcgtgtaccatctatgcgctttggggaaggtcatgtgtataacaactactataaaggtatccatacaactgcgattaactctcgtatgggcgcaaaaatgagaattgagcacaacgtatttgaaaatacaaaaaatgcgatcggcagctgggacagcagtcgagtcggtacatggcatgtcatcaacaactcatatattaacagctcaggcagtctgccaacgtcttctacaggtacgtacaaccctccttataactactctttgcttaacgtgaacaatgtcaaaacagaagtggtatcaaatgctggtgtcggaaaagtaaacccttaaaaccacaaaacgttcgggcagaattctctgtccgaacgttcttgtcatttcatctatttatattgtagaaaacgggcgatccatctcatacaatttttgatagcgtgggttttctttcagtaaatcctgatgctccccctgcatttcaatttgtccatcttcaataaacataatgcggtcacatgcctcacagccagtgagatggtgggtaatccaaatgaccgtttttccttttaacacacggaaaatggtttcaagcagctcacgctctgtgcgtggatcaagtccaacggtgggttcatctaatacaacaatcggggtgttttgcagcaaaatccgtgctaacgccatccgttgtctttctccgcctgagaaacgaattcctgtctcctgcacaccggtgtgatacccctctggcaatgattcgattgtatcgtcaagctgtacttgtctcgctgcttcttttacttgctcctctgtcgcatttggagagcctaagcgaatattgtttaaaacagaggtatcgaataaatacggctgttgattgagtactgacacataggtggacacgttctctcgaatgctttcgaccggttccccttggatactgacagctccttgatttggcacgacagctccttctaacaacttcaaaatagtcgattttcctgcaccgctttttcctaagagagcgagtgattctccttgcttcaatgaaaatgacaggtgctttagcacgtgttggtgcgaatcatacccaaaggacactcgatcaaaagaaacagctgcattttgagaaacatctgactgtttcgctgtcttgcgctctgattctccttcatacgaaagcttttcataatgatgtaatctgctgacagcatgctgatagactggaatatcacctgctgcatctgagagtggaagaaaggcttctgttaacggaaaaagcacaagcacgaaggctgcaatcagggtgtgtgacatcgagccagactgcacaactgaaccgctccaatacacgacaagcacgacagctcctccaatgataagctgtgccaaaaattggcgcagacggataaatcggtgcttggctgcttcaagcgctaacagctgcgcttctttctgttcatattcatcaacaaaatctttctgcctgccgctaaacaaccagtcactcacacccatgacggcatctgttaaatggctgtacagttcatttctgccttttttcatttgaatttgtctcgcccggttcactagcactgtgacgtatggaaaaacaaatacgagaagtgccatataaagcagcatcaagccagcaaaaggccacgagaatagaccaagtgccccaatggatgcggcatataaaagcagcgcaccgatggatggaaagatggtttttaaataggcgtcctgcagtctctcaacatcatctgacaagagcccaagcatttcacctgtacctagctttgtctgtttcgcacttcgttcagccatgtcatacagacggacacgcattttttcaatcatggtcaaaatgagctggtggctcgccagtctttctgcgtagcgggcagctgagcgcgaaataccaaaggtacggacagctacaattgggacgtagaccataagtatattctcaggtcttgtggcagcttttgaaatgagaaatcctgacgtatacatcagcatagaagcagagaatactgcaattgcccctagaaataaaaccagcgcaaacagcttttgattctccttgatataaggtataaaccagcctttacttaccatgtgtgaccgcccccatttgctcctgtaccaattgataatacacgccttttctttgcattaatgattcatgtgtacccatttctgcaatcgttccttgatccatgacaataatctcatccatggctggcatccaatggagcctatgtgtcgctaagaacacaagtttatcttcaaacagcggaagcattgttttcttcaattcatactctgtctcaatatcgagatgcgccgttggttcatctaacagcataatggaccgcttgcccagcaccgttcgcgcaagcgcaattctttgtgcctgtcccccgcttagccctcttccctgttctccaatgacctcatcgagcccatttggcagctgcgctacgagctgagataagccagcttcactggcagctctttccacttcttcatctgttgcatgcggctcataaaaacgaatgttttctcttaatgtcatgtgaaataaataagggtgctgcggcatatagacgacttccttttgccattccttcatctgtaaatgaacaagcggctggccgtttagcgtgatttgacctgaggtcggttcaacaaagccgccgagcacatcggtcaacgtcgatttccctgaaccactggcaccaatgatcccgatttttttcttccctttgacagtgaggtctacatcctgaatcgaataaggggcatgctcgtcatgctggacactcacatcttgcagggtgagcgcagattgttcattccactcgttcaactgcactgattgtgtctcctgcatgcggaagcccttttcttctaaaatgacctgcatcgcctcattcgcttcttttccatttagtgtggcatgataatcattccccacttcacgtactggcaggaaatattccggtgccagcatgagcgccgtcagagccggcaataacagaagctctccttcaatcaatcgcaagccaagaaagacagcgacggttgcaattgatagcatggaaaagaaatcaagcgcaaacgatgaaagaaatgcgaccttcagcgtgctcatggtcgcctttcgatatcgctttgacacttctccgatattgcgggagtgttttttgctaatgcctaagtaacgaagcgtttcaaggccgcggagagaatcagtgaaatgattggataatttctcatacgatctccattgtttggccgctttacgctgagcgacaagacctagcaaaatcataaagacaattaaaattggcagcgtcacgattaaaatgacggcagatgtttcgtctaatgtccaaacatagatgagaaccattgccggtatcacagccatgttcaccattttcggtaaaaacagctgtaaatactgacgatattgagcaatcccctccatcgctaatgtgacaagctttcctgtaccctttttctttgtgaaagcaggacctaaacgaaagagttggtctaacagctgttttctgacgtctgctccaattctggaagagtaggtaaacatgaccttctcccgaatcaaggtgagaccgtgccgcaccagaaaggcagcaagaaacagcaggacataaggcgttgtctgcgaaaggcttttcccgtcaaacagcgtagtaatggcatgtgccagccactgtgcttggaaaataatacttgctccttggatgagtgacacaatacctaagagggcaagaagccctctcattccttttaattgaagcaaacgtttatccattagtaggtcattggctccttaccgcttacacgtttacggaagacgtaatagctccaaatttgatacccaagcacaaagggcagcaaagaaatggcaacaatcgtcatgaccgtcagtgaataagatccagatgcagcgttttgaatggtcagatcaaatgtatggttgattgaactaatcatgacgcgcgggaacaatgcagtgaaaagcatcgtcactgtcaccatgatgcctgcacctgtgaataggaatgtccagccatcacgtttctttttcataaagaatagagccgctacgtaacaaaccacaatgaggaaagttaacggaatggtgatgatcgggcgtaccgtataaatgtctgtctccatgatagatacaccaacaaataggacaagaactggcagcgcaataagcaggacacgcttgccaagctttctcgcacgatctcttaaatcaccctctgtacgaagtgtaacgaaaatcaatccgtgcagaaggcaaagaaccgttacagctaacccgccaatcactgaataaaggttcacaaaatccgtaaaaccagcgtacatgttcatgtcttgatcaattggcatcccgcgtaaaatacttgtgaatagcacaccgagtaaaaacggcggcagcagactgccaaagaagatgacccagtcccatgctttgatccaagaggctttctcaaccttccctcggaattcaaaggctacgccgcgcccgataagtgctaagaggagaaccgcaaacggtatatagtatccactgaacatcgtggcataccagtgagggaaagcagcgaaaatagcgcccccagctgtaatcagccagacctcattcgcatcccagaaaggaccaatcgtgttaattaaaatgcggcgttcgtgcgcatcctttccaagcagctgcatggacatcccaacaccaaaatcaaacccctctaagaagaaaaatccaataaacaatactgcgacaagaataaaccaaatctcgttaagatatgccatgatatgcgcctccatcaaatggatctgtagataggtccgtttcatccttttgatctgtatcctcttccgaatgtgcaccttttttaatttctcgaatgaataggtaggcaagcaagatggcaagaatcagatacatcgtcgtaaagctaatgactgagaataacagcatgccgtacgatacgtttggcgaaatcgattgagccgtcgtcatcataccaaagaccgtccacggctgacgcccaatttcagtcatgatccagccagctgagttcgcaataaacgggaatgcaatcatccctaccatgaaacgtaaaaaccatttgttcgtttcgagtttttttctaaagctcaagtacaagccaatcatactggcaaaaatcatcagcataccggcaccaaccataattctaaagctccagaaggttgtttttactggcggaatatagtctccaggaccaaactttgcttcatattctttttgaagtgtcagcatgcctggcacatctccactaaacttcgaataagccaagtaacttaaagcaaacggaatattgatctccgcagagttttcttttttatctgtatcaatgttggcaaatagtgtccaagccgctggatctccactatccttccaaagggcttcacttgccgccatcttcatcggctgtgattccattaagtgcttcgcttgatcatgtccagagaacgccacacctaagccagaaattaaagcgagaaccatggcaatctggaaggactttttgaaaaaggcaatttcttgttttttgatcattttataggcactaactcctgcaataaagaatgcacctgtagccagcgcaccaaacagaacgtgcgggaattcaacccaaagctgcgggtttgttacaagtgcgccaaagtcattcatttctgcacggccatttttaatgacaaacccaactggctcttgcataaatgagttggcgagtaaaatccaaaaagccgaaaagatcgtaccaagggaaacaagccaaatacacaataaatgaatcttcttcggcagacgatcccagccgaatatccaaagtccaataaatgtagattcaaggaaaaaggcaagcagtgcttcaatggcaagcggtgcaccaaatacatcaccgacaaaccttgaataatctgaccagttcatcccaaattggaattcctggagaatccctgtcactacacctactgcaaaattgagtaagaatagatgaccccaaaacttcgccatttttttataaatctcttttttcttgacaacataaagggtctgcatcaatgcaacgataaacaccaaacctattgacataggaacaaaaataaaatgaaataatgtcgttgaagcaaattgaaatcttgctaaaaacagctcactcacagccttacatcctcccttactttcacatgccgaatgattggaaacgcttatgctcatcacttcacaaaatattcactatttgttcaatggttcacaaataatagcctgtttgaaatgatttactcggtgaaattttacccttgcttttcattcggttagttatttatacctgtactttacacccatacgtttcaaaaataaagtaaattttacctaaaaattggatggtattgtgtcagttgtttgaatactttgtcaaaaatatgtgacagaaagtaaaaaaatagcgctgcacgtgagccgcagcgctgtgtttcttttttaagcttttttctgtaaggctggtctagtaacttgcacttcatagtacgtaattttattttttaataggccttcaggtttcgcttttccatgagcatgcgcatcaccaaatgcctgagattttgtccaattcacaaagtcttcttttcgattccagcgtgtatgaatggtcacttcatcgtaatcggttgtctgctgtgtgacccatacttccatacctaaaaacccttccatgaattctacttgtccctgcttgttaaaacgcttgacgaggtggtcggcactgcctttttctactcttacctggttgttgacaatgatcatgttttgttcatctcccttttgttgttggatcgaagcgatcggaataatcagcgggtgctcaccgtctaagtgaacctcagcctgaatcccaaagacctctttgaagaagctttctgttaatacttcttttggtgtccctatttgataaacctgaccacgcttcatcgcaataaggcggtcacaatattttgctgcctgctgcaggtcgtgaagaaccattaaaatggtgattccatgcgtcttattcagctgtttgagcaactctagtaaatcaagctgatgcgcaatatctaagtaagtcgtcggctcatccagaataatcgtctctgtcttctgagcgagtgccatcgcaatatacgctttttgcctttctccgccagacaatgtatgcagcattctattttcattgatacggctattggtcacatcaagcgcccactcaatcgcttcttgatctgtcttcgagctttttttccagatcgaacgatgcgggctgcgtccaagtgcgaccagctcccgtacggtcatagatggaatggctgttctcgtctgcatgagaacggcgatttcctttgcaatctcctgagctgtcatctctttttgcggtatatcgtgaatgtatatcgtgccgctttcgattgacgtaagacgtgcggctgctttgataaaagtcgacttccctgatccatttggtccaataatgcctgtcacgcttcctttaggaacagctgctgatatagaggacaactgaaagcctccttgactgagactcacgtcatccatagcgatcacatccaacttaacccctccctttcttttttaataaatagaggaagaaaggtgcaccgatgcaggcaagcaggataccgacaggcagttcaactggtgtaaaccatacccttgccgctgtatctgcaaaaaccacaagcacgcctccgcccagcatcgagatcggcagcaggtacctatagtcatctccaattaaaagacggataaaatgaggaacgaccagtccgacaaagccaattaagccgctcacacttactgctgcaccagctaaaagtgccgccagtgcaattaagaaaaaccgggtgcgctctactctgagaccgagcaactgagccgattcatcgccaagcaaaagaagatttgccggcttgatggcaaaaaaacaaaggcacagcccagcgagcgcataaggcgacacgaaggttagatgatgccaactccgtccatttaatcctcctgataaaaagggcaggactgcctgcacacgctcactataaagcaccataaacccattcatcaccgccccaagcagggcattgactgccactcccgccaaaatcagcttcagcggtgaaaccccttgatcaaatgagagcatatacaccacaagtgccgctaataaagcgccaaggaaagcagcggctggcagcaaatacgtgaattgcggaaacacaatcatgctgagcacagcagccaatccgccgccagccgtcacaccgatgatgccagggtcagcgagtggatttcggacgactccttgtaaaatcgcccctgatgccgcgagacaggccccaacgatgaaaccgatgagaacgcgcggcaggcgtaaatccatcacaattttctcatggacaggctgacctgatcccgtcaaagcagcgaataaatcttgcagtgataattgaacagaacctaatgcaagccctaggcatgcacctacaactaacgagatgaatagtccgggtatcagccatcttcgcctcgactgtcttttttgaaaatctaattctgcattcattttcatgatgacaatcgcttcaatcttttctctagttcatcaatcgctctgatcacatctgcgcctggattcgttccaaatagatcactaggcagaatctcgacgtgtccatgtttgacggctgatacatcgtgccaagcagcattctgtttcatttcactcataaagcccgctttcacatcttcaggattgctatgggtcatgagcaggataagatcaggatcagcttcgatgaccttttctgcattgatttgagcgtattgagggaatttctcgagagctggttcattctcagcaatgttcgtccctccagcgatgtgtagtaaatctccgcttaaggattgaggaagagccgccatatatgtgccaggtgccccgtacacaacgagtgtcttcacttttttctgaggctgtttgacctgatttttccgctgatcgatttgcttgttaagctcttttgccttttgctgcttccctagcaaatctccgaataacgtaatttggcgctggatgtccttcacggaattggcacttgtcaaaagaagctgtgaaccaattccttctattgtagagatgtccttgctgtttaattgttcattcccaagtacaacatcgggctttaagcttgtgatgagctctacatcaaattgatgtgttgtaccaattgtttggactgatgtagcctgttgtaagctgtctggtaattcggtggccggacgaccgaccacctcaccgcctaaggcatataggatgctcatgtctccagtcgacaatgagacaatgcgctgaggggattcttcaaacgacagcgttctgccggcaaagtccttaatcttcagcgcaccttgaccgctccctttctctacaggtgctgcctgactgcatccgccgaggagaagcatcaagacaagtcccatgaagatcacatgtgaaaatttcaaccgcctgtctctccttttctagtaaactttctttagctttgcctgtaccacgagacgcccgtttttcggtgcaagcacatgatcacaggtcgatagagtgagaataaggtcatctgtggacacgtctgtcttcgtttggtagattgatttttttcgcacagattgcaagtagtgcgcatattcgccaagatcttgaaaatcggtttgtatataatcaaagtccaccgttgtttcatacacggcaaaaatctccgcctcatagctttgatacagcgtatcgtactgaaatgtccgatgctcatcgaagaaatcctcttttaaatagtttgtgagtccagcgaacatggacccatccctcattcgatgcccgtacaccacagtattcgggctttcatgcaagacatcattgcgataatccataaaaatactgcctgccctggtgtcgttttttaagtaattacgggttaagtagaacgcattgtcgcgagattggacgattgggtactggatcatcgtgtccttcatattgatccagccgacaatgtcatcgtttactttccgcagttcatcaaatgacgtacgaatggtccccgactcccggttttcattcattccttgctcatgtccatacatcgtctgagcctttgctagcacctgacgattttgataatagccgaacagttctaagccaatggccgaaccactataaatgaatacacctaaacagacgattgtcagcacacgctgacagacccgttttcctcttttcacactgtctcacctgctttttgcacagcttatatcccaacaggcacgatgtacatccctgtttctgcatcctgtttaatcgtgacagacacatcataaatgtgccgcacattctcttctgttaacacatcgcttggctgtccttcactcataatccggccattcttcatcgcaatgatgacatcactgtagcggacagcctggttcatgtcgtgcagtaccataacaattgttagtccatgtacgacattgagttcacggatcagctcaagaatgtcaaattgatagtagatatccaaataggttgtcggttcatctaagaaaaggattggtgttttttgcgcaagtgccatcgcgatccatactcgctgccgctcaccacctgacaatgaggcgagcggcacctttcgtttttccgttagctttgtactggaaagtgcccactctatcgctctctcatcctcttccttgtctccacctcgcatcgtctggtacggcgttctgccgaatgccacgaccctctcgatcgttaaatcaagcggtgcttcgttttgctgatggacgaccgccagcttttttgccagctcctttggcttaaacgcattcaacgcttggccatctaaatgaatctgccctttgtttggcgcatggttatgcgccattaatgaaagcaatgtggatttccctgagccattcggaccgataatggttgtgatttttcccttttcaatctgtgttgtgaccgattgaaggatgtccttctgctggtcatatgagaatgacacctcacgaatgtccatggagacgatccccccttcttagtaaaaagatcagaaatggcccgccaatcacggccatgatcgtagaagcaggaatttcatttggcgcgacaagcgtcctgccgagcgtatcagccgtcagaatcagcaacgccccgcttaacgcagaaaatggaatgagtacccggtgatccgacccgacaagtcttcttgaaatgtgcgggataagcaaaccgacaaaggcaatcacgcccgctaccgctgctgtcaccgccgcaagcaatacagctgtgatggaaatcaaaaggcgcattctggtcacacgcaatcctaaatttttcgctgtcttgtcctgaagagccaagaggttacaccatctgctaaagaaaagggctacgacaaggccgacgacgccatagactccggttaaacggacatccccccacgttttcatcgtgagattcgactgtcctgactgattgatcgtgatattgaaataactgcaaatggtcacaaatgcttcagccattccagtaaacatggcattgatggcgatcccaaccaaaatcatacggatggggcttaatccacccttccaagacagaacgtatacgaggaaacacgcaatggctccgcctaacaccgaaaataaaggagagtagaaataaaattgaggaagtgctgttattgccattaaagaaaagaagctggctcctgatgaaattccaatgacgccggcatcagctaatggattcctcatgaccgactgcagcagtacaccggagacagataatgcggcccctgtaaacatggcaatgagtatgcgaggaattctaagatctttaatgatttctacctgtgcatgttgaccggtgatgagcccttccaataattcaatcggggtgacatgaatgctcccagtaatggcggaataaataaacacgcacaccagtaagacactgactgtcagaaataaaatccctgtttttttcatcttaaacgtccttttatcattcagattcgccgcttataacggatacagcatacgcgttagttcatctaatgcttcagctgcttttaaattgcccgttgtcccaaataagctttcttcgaggtcatacactcggtcttgcttgactgcatgaaaatgcttccaaatgtcatttgttttaaattcttgatcaaacatgcggacgacttcatctggcatcccatgtgcggcccggaggatgatatctggattggctttttgtaaatactccgtattggaagccaagtactccattttctcacctttgacaatattctccccgcctgcgatacgtacaagatcaccaatatatgaatgctctgtcgccaccaaataactgcctggtacaccaagtaaaatcagaacggatggctttcgttttcccttcgtcttctcttgtatgtctttctttttttgttcaaaatcagtcacgatgcgcttggcttgtttctttctgtcatactggtctccgagcttcgtgatcgccttctccatgttagccatgctctcgagatttaagtatgtggtagggacacctgcttgctgaaagggtgtctctaaatcatattgaagggttgtcacagacaggacatctgtcggttgaagtgattggatgatttccatgtccgggctcattggattgccgacttccggcagtcctttataacgagctggcaaggatttttggcttgttggcaccccgacaagatcgatctctaaggcatccataatctccacagcagctacagttgttgccacaatgcgttcacttgattctacgctttttttgccttttgctgagctttcagctgactgtgagcagcccgataagatcacgcacacaccgagggcagcgatcaaggtatataacattcgatgcttcaaaaacagaagccccctttcgaaaaaagagagtggatgcgtcgatgatctcggcgcatctcacttcaactaaaccatttatcttgttcttgtttgatactttctaacgagtacgaataatgacccgccgaataaaagaatatacacccaaagaagagaggtatctcctgtttttggattcagctgtccagtctcagacttggtttggtcatctgatggagtaaaagttaactgctctgcgcctgtttcctccggcactaaattctcaagttgattcggttgatttggttgagaatcgcgatcatttggatttttaacaaagccgacactctcatcgtctccgatgaccgttcgaatcccgcttccttcaccaagagcaattcctttcgtgtcatagataagtttgacatcgtactgctcatgataattcgcagctggaatatcaattttcacgcgtgctgcctgagccgtgcttaagcttttggcttcgtattgaatcactcgtgtatctgatttttgatctatttttgcaacaagcgtctcttcaaactttccacctgatcctacttggaaggacgtgatagctgagctattcttcactgtataagaaacgaaatggcggccatttttcacaaccaatgtcgcagggctcacgacgtaatcgttcatacgagaaagctcatccttgtctgctttcttcattgagaaaggaagcttgtatacaccatctttaagctgagccgtctcttgaggagctccgccgttatttgtttctggtgatggtgtgtttggttttggtgtttctggtgcagcaggtgtttcttcctctacctgtccgcctttaagtggcgcgatactctttgcatcgaattgaaaacgaatatcgtaggtttgctcatagtgagcggctgctactacaacgtgtacttttcctttgaccgcttttttcaaatcagcgacatcaaatgacaccactcttgtgttctttgctttatctgtgctgacagtcttcacttcttgaaaagaaccgtttttctctgttttcaaggaagcgacagatgtatcgtccttcaccgtaaaggagatggttagtttcccatttttgatggttaaggatgcaggatgtgagaagtattggttcatccgagatgcctcatcctcatcccctttgagcacactgtaattgatgcggtactcgccatctttcagttgattttgcgtaggatccactggctttgtgccattgttattgcctggtgttgtctgctgatcgtctggctttgtgccattttgatcatccggttttgtttcgttatcgtctggctttgtgccattttggtcatccggctttgtttcgctatcgcctggctttgtgccattttgatcatctggttttgtttcgttatcatctggctttgcaggtgtaacgagcgttaggctgctttgatcgaatgcaagctgtacgtcatatgcttcgtcatagataaggccgcctaaatcccagtaaattttcacccagccgtttaatttggctgataagtcggcaacatcaaacttgattacacgtgtattggcagtttcatcctcactgacggtttcagtggtgacaagcgcgccattttgttcaaccttgaaatctgtaatctctttgctttgcttcagtgtgacataggcagtcgtcttgccattttccacaatcagcttagctggcttttctgtatacgtatccatcatggacgcttctgtgctgccattttttaaaatggtgaatccgaccgtgtattcaccatcaacaaatgatgcagcttgagccgttccttgaggaatctgaaatgcagtcaataaactgaataaaacgagcagaatggctgcctttagatgaaaaagacgtttcaaatggtgacacttccttccttaatgcttaatgatccactttcttgctaaaaatccgcctgagcatagagcaagcacaaggagccaccctgtctggtttgtatcaccagtttgaggattctcttcttgttttgtcgtggatgaatcagatgttttcgttgattcttttgatggctgctgcttttctgcttcacccgctgttttgtttgtgctgttagacgaaagtgatttcatgctgctctcatcaaatttcagctgaatggtataatcatgatcataatcagcagattttacagtgacatgaatttttgatttgattggtttagacaagctctgagcttggaactgaacaatccttgtgttggcttttttattggttgagagaaccgttgtatcgacatagccgccatttccgggaactttaaattccgtcacccagctgctatttttaatggtcatttgtactgtcagcttcccattttttgcaatcacttttgctggcttcagccagtagtcatttgccatggagaccgcatttccttcagccttgagcacagtatagttgacggagtatgtaccatcctttaacgtggcagcctgtgcgtttgaaaaaggcagcatgagtgccaataataaagcggtcatgaagactgatagcctcatcatttttttcatcaagcgaatttcctccctttttattgaacagatgctgcatcaaacttgagacggatgtcgtaattgcctgtatatccaatgaccggtacagtcacgctcacttttgctggtacgacttccgtcaggctgttcacgttaaattctactgttctcttattcgcagctgtgtttgtactgatcaccttcgcatctttgtagacaccttgttcaagtgttttaaagctagtgatccaagagctattcgttaacgtgacttgtgctttgattttcccatccttcacgacaagctttgctggtttttcaaaatacgtattcgctgttgaagtcgaatcgctatctgccttccataccacatattgtgccgaatgttgaccatctgctaagcctgctgctgaggctgagctaatcggagctagagcaaataatagaacaaaactaaagaacaataatgcgtgtgatgttgaacgaatgactttcatgtgaaccctcctaagtgatattgataattattctcaatagacaataaaaaaaataaccttcataagcgcttgaacacacttatagatgattatgataatcattatcaattgagttgaaaaaataaatctttgcttcctaaaagccaaagatgtctgtttctaaatgatgatttgacacgtgttttaggcaatctgtcccattcatgattccatggcatgacctccattccattacagggaaaagaaccctcttcttcttgatcttatatgatgagtgaatttattgtcaacatcatttttcatactattgacttagatttctggaaaatcgcacaaaaaaatttcgatcagacagactgatcgaaatcgattaggaagaaacatgttccacttttttgctaattttacgttctaaagaccaagcatacatttcacgaataatcggctctattttcttcccttgcgctgttaattcgtattcaatccgtactggaatgtcagggtatacgtttttctcaacgagtccttcagcctctaaatccttcagcctttcagataataatctgccgctgatgttcatttcattttcaagctgacagaaacgcttagggcctgtcagaagctgattgatgatgagaatgacccacttcttgcctagaatctccatggcatctgtgattggacagccatctacttgagccataccttactccctcccgcttttctctctttttttcattataacataattaattacttgaaataagtcactaactattatatagtttagttactaaaagtaacaaggtattcatttttatcaattttcaataaaccattgaacatgcagatgcatataacatgaaggagatgaccgagctttgaatacaatagagcaggtaagattaggtgtaacagaattacatgtatccagctttgagcgttctttgcctttttatacagacattttaggttttactttattagaacagacggaatccaccgtcactcttggaagcaatgcaaaggaaccaatccttttgttaaaagaagatgcacagctcaaggagaagcctgatcatgagccaggcctttatcattttgctgttttattacctaccagaaaaaacctgggcacatggctggcacatgtgatcaaaaaaggctatcctttaattggagcaagcgatcactttttcagtgaagccatttatttaagtgaccctgacggcattggcgtagaaatatatgctgatcgccctgaggacgtttgggtaggtgagcatggagaactgaaaggtggcggaaatgcacctcttgatggagatggtctcctgcaagaagccgctgatacgacgtgggaaggaattccagctgggacagtcatgggacacttacatttccatctgaacccagaagaagctgattccttttatgtcaatacgctcggttttcatatccgaatggctcccacagcaagcttattcattgcaggtggcgtctatcatcaccaccttgcctttaatgcatggggacgcggaagaaaaggagccattgatccacgtttttcaggaattagaagctatacactcgtattcccacaagaagcagacaggcagtccgtcgttgagcgcctaacaaaagcaggcactcaagtgaaaacaataggggaaagtaacgaatttgttgatccatttggcgttctcgttcgtttacagattgaagaaacagacaaaaaagaaggtgcagaatatggacaaacacacagatcttaaaacagccattttaaaagataaaatcaaacgagtacagcaagaagacgggtatatatatatcactggacccattaaattgccagtgaatttagacggcagaacggtgatgttcaactggtattcatggttaaaagacgacggattagagccattgtcagatgacgctttaatcgaaagcctctcgtcccgccagcttgccgatcatcagcagtcaagcgtgctagtgtatggagatttcgaacacgctgacgaagctcttatccgcatgcattctatttgccatactggcgatatttttggaagcaagcgctgcgactgcggattccaattgaagcagtccatgcgaatgattgaggacaatggtgcaggtgccctgttctatttagccaaccatgaaggccgcggtattggacttttcacgaaagccatggcttatatccttcaagaaaatggctacgatacagtagaagcgaacgaagcactcggctttgaagatgacacgcgtcaatatgaagaagccattgcggttcttcaaacacttcgtacaaagccagtcagactcattaccaataatccgaaaaagacagatgccatcagccatgcaggtttatctctgtctggacgtattccgctttggggtgatgtctcggagtttaatgaaaaatacttgcagacaaaaattaaccgctcaggtcacatgaaggcggatcaagaggtgcgtacgattgccacatcatgagcgatatatgaatctagcacttgaaaatgcacgggcaatgaaaggccagacatctccaaacccgctcgtcggggctgtgattgtgcgtgagaatgagattgttggtgtcggtgctcacatgaaagccggtgaaccacatgctgaaattcatgcacttaaaatggccggagacaaggcaaaaggagccaccatttatgtgacccttgagccttgttctcaccatggtcgtacaggtccttgtgcggaggcacttgtgaaagcaggcgtcgaaacggttgtcgtggcggctcttgacccgaacccgcttgtcgctggccgcggaatcgccattttacaagatgctggcatccaagtgattacaggcgtacttgaacaggaatccattctcatgaatgaagtgtttaatcattttattacgaaaaaaacacctttcgtgacgctcaaggcaggtattaccttagacggaaaaattgcgtctgctacgtctgacagcaaatggattacatctgagacatcccgttatgatgctcatcatatccgcagtatcaatgatgcgattttggtcggtgctcaaacggttattcatgacgacccttcactaactgcacggattccaaatgggaatcatccgattcgaattgttttagactctaagctatcaacaccgctgacagcaaagatcgtcactgatcagatggcacctacttggatctttacaacaaagcaagccgatgaggaaaaacgagacgctttagtagcagccggcgtcagcgtctttgtaacagacagcgagacgcgggtgcccctgcaagaattgcttcaaacgctgggagaaagaaatgtctcctccctcatgattgaaggcggcggccagatcaatgcttcatttttagaacagcagcttgtagataaattggtcatttatatggcacccaaactcattggcggaagactttctccttcctttttcggaggcgaaggcatacgcctcatgagtgatgccattgaactcgatcagctctcagtagaaacactagggaaagatattaaaataacgggatatcccgtttatcaataaacaaaaaagtttgtagaccccatctacaggcttttttaaaatgacagcttgaggtgaatgtgatgtcgataaaaggaatgaatcatttgttattttctgattctgatttagaaacctctattgatttttacacaaaagtatttgacgccactttattagtaaaagggaaaaacacagcttactttgatttaaatgggctatggcttgcactgaatgtggaaaaggacattcctcgtcaagacatccagcactcttacacacacatcgctttttcaatcgatgaaaaggatatagatcacatgcacaacaagctaaaacatttgaacgtcaacatcttaccaggtcgcccaagagatgaaaaagatcatcagtcgatctactttacggaccctgacggacataaatttgagtttcatacaggtaccatgaaagatcgaatcgattattacaaacaagaaaaagcacatatggaattttttgatgaatgataaaaaaacagaacttccatttacatgaaagttctgtttcgcttttgaaccgccaatgtcgattcacccatcatcaccatgaaacttgtcgtaaattgtttcatgtgaaacatttatcgttaattcccttctaccagcctgccaaagctttctggtgaaagtcccggtgaaatgcgaacacggtgcaaggacatcatgccttgttcctttttcgcatgtcctggttcagtggtgacagccatttgataaccggcttctttcgccagttttagcgtgtcttcgttatagcgcccgacaggatagctgaccattcgcgtacgctgagaaaaacgttgatcaaagaatgcctttgatccttttaattcctctttctgctgctcctttgataaacgattgagctctaaatgatgtattgtatgactctcgatcgacagcccatttgctatcatttcatccatctgttcatccgttaaatggttcggacggtcaatggattgctcaatcatgaaaatcgttgccttcattccatactgctttaaaatcggaaatgcctttgtatagttatcggtatatccatcatcgaatgtaatgaggacacacttctcacttggcttcgtatttgttgtgaagacgcggtacgcttcttctggcgacagcgtgacatagtcgttgtccttcagccatttcatatgagccgcaaactcgcgctttggtacacgcagcgagttaccactggagatgctgtgatacatcaaaatcggaagctctaccggctcctcttgctcaatccagctttgtctatcaatctctatcgcttctgcctgctgaatctcttctgtttcttttaattgtaatggacccttttcctctttgaccacctgctggtttccttccgtttgctctttcgttcccatacagcccgaaatgagcagcgccaaaagaccaaccgtcatcaacatacatgtttttttcattcaccaatcctgctttctctctatctatcgaatgattataacagaaattggttactagctgatatctattttgacagggtgttcatttttttacacatttcaatcatttcgatggcaagcagatgaatggtctctgttgtgagcatttgatcttctgcatgtattagcagcaaagaaaagggaagctgctcacctgccgcctctttttggatcagcgacaagtgaaggttgtggatgcttcgaaacgcttcctcccctttttcaatcaactgctgtgctttttcaaaatcatcagctcttgctagacgaatggcttcgacataatggcttcttgcctcgcccgcatgagcaatgatttgaaaggctgccccctgcatttcctctaataccgtcatctgcttctcctccaattacttaagattcatttgctagtttcagagcatgttctagtattttttctccgttcgctgttccgtataatctcacattgatgacatcgacaggtacttggtaaggtgccgctgttttttctgctgcctttttcataaagcttacttgcggtccaagtaaaatcacctgcacatcttctccgtgctcttctaattcatccgcaatagccccttcaggtatagcgtatatatcatattccagccccttagcttctgcggctgccttcattttggacactacaatggacgtcgacattcctgctgcacaagcgagaatgattcgtttcatatcccaacactcctatcgatagttgacttctgtttcgaccttcagttcccttgttttaattaatgtctggtaccaatatgctgatgctttcaactggcgattccgttcattttccagctggatttcgactaatccgtagcggtttttaaaggcattcatcggcgatacattatccgtaaaagcccaaagcatatagcccgtgcaatttgagcctgctgcttttgcttgaagtgctcgctttaaatgctggatgataaaggaaatgcgatactgatcatcaatgataccgtcttctcttttaaaacgttcttccttttccacacccatgccgttttcggccacaaaccactcaatatttccgtattcttcttttattctcatgcccatatcatagacaatgtccgggtagatttcccagcctctgaatggattcatttttcttcctggaagctcaaacatatcgtaataataagacggatgaaatggcgtcatctcattccacgccttactcggtgctttgacccgatgcggatagtataagttgagcccgacgacatcgaccgtatgattcttgatgacctgaagctcttcctctgtcgcatcaaaaagaatctcatgctttttcaacacatcgagcaattcctctggatactcccctttgatggagggatctaagaacactcgattgaaaaacaaatcatacatccgtgccgcttcttgatcatgcggagcagaggatcttgcatacgtcacttctggattgagaatcaccccaatttttgcaccagttgattccttcaatcccatctcccgaaacagcttcaccacttttgctgttgccagtgctttatgatagttccactgcatccatttcttcgtattttgctcaaagggataacggatagcatctaggtacacgcgtgtttggacaacaatcggttcattaaagctaaaccaatgcttgaccctgtctccatatcgctcaaacaccttttccgcatagagaacaaacagctcgacgacatgctttgatgaccatccgtcgtacttttcaagcagcacggctggaagctcataatgctctaagcaaaacatcggctctacacctgctgcgattaattcattgatcaaatcatcaatgtaacgagcatagtcctcatccacaatccccttctcgtaatcgataaaaaatctcgaccaattgatcgatgtcctataatgagtcaggccgatttctttcatgatggctacatcttctggatagcgctcgtaaaagttcgtcgcaccagccggtccatatccttcgtgccatacgtgatacccattcttataccataaatcgatatacgaatcctgatgcgcctcctttcccttccatccctccgtttgccaagcagaggccgcagcacctaggataaaatctcttggaatctcgattctgttcatgtcgccacctttcctttcctcgtttgaacgtgaagtccttcccaaattccttgcaaatacatagccccaagcgcccgatcatataaaccgtagccatgcctgcctgtctcgccaaagatcatacgcccatgatccggacggacatagccagcaaatccctcttcatacaaagccttcacaattgtccccatatcgagacttcctgctgatgaaaggtgcgctgactcttcaaaatcaccgttttcatgcacgagaacattgcgcaaatgggcaaagtggatgcgtccttttttcgcatatttacgtgcaagtgacggtacatcgttctgcgcatgacagccgagtgatcccgagcaaaacgtaaaaccgtgctgggagcgtccatcgatctgaagaatacgatccaactgcttttcattactgacaatacgaggcagtccgaaaatatcccaaggagggtcatctggatggagtgccatgttgaccttttcttcttctgctaccggaatgatatgttgcaagaaataagacaggttctcgaatagcctttctgcccctaattccctgtaatcagccatcaattgtttcatttccacctgtgtataagaggtatcccatcctggcagtgaaaatggatctttctctatgtccatatgttctagttgatgctgaaaataggctagggtcgtcgattgatcagccaatgaaaggtcgagctgcgttcgtgtccaatcgaggacaggcatgaagttataacaaatgaccttcacaccgtgcttcgctaatcgtcgaatattttcttgataatgcttgatataaacgtccctctttggtttaccgagtttgatgtcttcatggaccggaagactttcgacaacctcgaaggagagatcatgtttctcaatctgttcttttacatgagcaatcctttcctcaggccacaggtcaccagctggcacatcatagacggcactcacaatgcctttcatgcctgggatttgacgtatatgcgcgagtgatacgggatccccctctccgtaccacctgaattgcatgttcattcatgtcactccttttattctgaatctggtgccgcttctggtttgcggttagacaagagaacaaatggcaaatagatgaagactgcgaccacaatacagatgagctgtgtgatgacagcccccatgctgccggcggtggacagccatgcattcacaatcggtggtgtcgtccacggcaccatcacgacggcttttccagcaaaccctgtagccgtcgcaatgtaaccaatcgttcctgtcacaagcggtgtgacgataaatggaattgccatcacaggatttaacatgacaggcaagccaaaaataacgggttcattgatgttgaagaggcccggaccagatgagagcttggcaatacttcgcatctcttcccttcttccagcaataaaaatcgcaatcaaaagcccaatggtcacacctgaaccaccgatgctcatatacacatcccaaaatggcatcgtgatgatattcggaatctcttttccttcttgaaatgctgtcatatttactgcaattgatcctaataagagcggctcccgaatcggtttgatcatctggttgccatggatgccgatcacccagaaaaattgcgccacaaacatcaacgttaaaatccctggcagaccctgtacaacactttctagcgggcgctgcaccacgttatacactgcttcatgcaaataaatgcctgtcaaacgatgaaatgcaaagccgaatgaactaatgatcgtaatcgtaatgatcgaaggaaaaagtgacgaaaaagatgttgccacattcgatggaacagaatccggcatcttgatttgcagccatttcaccttggtcagcttacaaaagatttccacagatacgattgcaatgatcatccctaaaaataaactttttggatcggaaaattgccttgccagtacatctacaacttcacgcatcgatccatccacttcaagaagaagtgtcgttggaataacagatataaatgaaatcaatgccatcagccctgggaacagagacttgtgcccgttgattttcccaagctctatcccgatgaggaacacagccccaatggttaaaaagttcagcgtggcataattgattgccttcataattggctgaagctccgctaaaaatctgaacatctcaaaatgagcaagccctgtttccgggctcatgatcatatttgccaccaatacagcaaaagcccctgtaatgatgattggcatcaatgtgacaaatgcctgtttaatcgccataatatatttttgattcgtgatacgataagccacattccccatgacgtctgccgctttctccttaaagctcatgatctgtctccccctttgcaaaaactcgtgatcatcctcctttgatgttattttaaaagcgctttcattaacatctaatctttttcctcacagatgcggaaatgggtgtcccgttttttcatttggatgctccaatacttgcagcgccgccgtcagttcctcaaatgaagcggccttgatgagttgctctaccacttccttgcgctctgtcagccgtacaagaaattgatacagtgactgtaactctttttgatacgtcttctggatactcaacaaacaaacgacttgcacccgattttcaccccacaacaccggttttttcaacgtacagatcgcacaaaacgtgtcatctgttgctggcttaatcggatgaggaatcgcaactaaatgaccgaacgatgtcggtgacacttgctctctttccagcaataattgttcaaactcttccgggatgcgatcctgttccttgagcacatttacgaaaaattgcagtacctcttcccttgattgaaggtcttgctgaaaatatgtcagctccggacttacataccgcaaaacccctgtatcctgcggaccctgcacaaagcgtttcagccgcacaatatcatcgtcacttagaatcgtatgtacatcaattactggcaccggcaacgtgttctgaagcggaatggtactaataataaaatcaatgcttctcaaatcgtacgaagaaatttccccaacacttgcagaaccagcgatatccagccttccgctaaaagctgctttcagcttatgaagaaggagctgactgctggcgacacccgtcgcacacacaatcaggcatctctttttcacatgctgtgattttgtccgctcgattgcagccccaatatgaagcgccaaatacccaatctcatcctcatgaatctcaattccctctttttctttcagccatctccccatataaacgccagcttcaaatgcaatgggataatgccttttaatgtccgttaaataaggattacgaatgttcataccgtacctaaaacgatgaatagcggaacgtaaatgaagacttaatccaacgatgaattctttatcaaattgaataccaagtgacatgtgctcctctacataagcaagcaattggtggatgaagcgaaagtgatcttcttctagaaggtgaaatagcgtatgacccgcatctccgtaagccatcatcttagctcccatcaagtgaatcgcaatatacgccatttcagataatggaaaatcaattgctaggacatgccgaatgtcctctgccatttgttgagctatttggaaaacaggctgcacttggatctcttttaattccatttctggcatcatgactagttttttctcttcaattcgtttgcatgctatggcgatgtgggtgactaaattacttaaaccgatttctgacagataaagtccactagcttttgtacgtgaacgcacgatatcctggatcaattgatacgtttcttcaggtaacagcgccgagttcgcatgcgcttgctgaaacacatgctcagccatacaatatctcaatttcatttcatctcctgtcagccgcagtccatatttaggacgatgtgacacagaaagtccatgtaatgaaaacaaatgtctgaccgctttcaaatcatttttgactgtcgattcactcacaaataattcctctgccaacgcatctaacttaatatagtcttctgatagaagcagccttttcaatagaaaggctacacggtcttcaggctgattgggaatgatctgttcctttttttcgcttctttctctcaatgactttttcaaaaatgtacgaaaagacccataatcctcgacggtcaatgtataccctgccccgcgtttgatatgcagtacggctccacattcttctaaaatagatttaagcgctttcatatctgttcggatcgttcttgatgtgacgccaatcatgcgagcaatttcttcactagtcagttcctgttccgcttgcatcagtcgtttcagaagctcctcctgacgtagagatagcatgatctctcctcccttggcatttacttttgcctttcatcataaacgaaagtagaactctttgcccagtttttctttcaagtcgggaaccacgatatggctcattcgtatgaatagaaaacaagaggagggatgcatcatgggttcttttatgtttgttattatgatgatattggcttctttaggagcaatcattgcccatttattcacatcaaaggatcagcgtacgtctgctaagcgttcttcacatcacagttcaacaacaagtaactatactgattcttatactcatcacgcttctgatgcctcctgcggaggagattccggggatagtggtggtggatgtgactaaacaaaaaaacagccgctcgctaatgagacggctgtttttattattttaaagagccttccagccccgttcaatcagatgtttaacatcgagtgcaaaatcctcacccttttccatcacgtcctgggctcttccggcaaagttactggcaacagccagctccatttttttcaattcaaagtgcaagattttttgatcaatctctgcgatatatttttcatactcattgttcacgatgtcatgcatgacatgataagcatcttttcggtggcgatgaaagtcggttcctctctcacctttccatgacgaatctaaagcaggcttcttgatttcctttatgtcagactgcgcaagatcttgttctgttcgaatattgcttttggctatctttaaccgagagatcatgtcatcaaattctgcacgtctgttttcaattcccatatgcagatggtgtagcatctcggataaactcatgtcatccacctctatcgcacctcatacgaaagcacagatcagagccttggaaatgatcgactcacttggtttttccaaacctggcatttctatcgtttggctttcattaagtatagtataaggtgaaaagcctcagtcttaaatagggaaaaggtgtccttttagtgacgtgtttggaagaaaaacggaataatacaaggtcgtacatcctgatttatatatgagcccttagatctatatttcgtatcacaccatgaaacccattagaaaaatgcttgccattattttgccgcaatcgcttcgtcctgttcttttaaggttttcacattcgagcgcgtgtcctggacatttttggttaaggcttctttaaaacttgagaccatttcgttcacctctgcctcgcgtgccgtccacttggttacaaattcaaggctgttttcacctgctttatctgctgcttttttcatcgttaatgcttcgactgcttgggagacttcatctagttgatccataactgtttggtagtttaatttaatttgtcccatcttgatatcctccaggtttgttcagcatgaaggggcttataagctgctccatgcttttgagatcaagcgtttggcgtcctctactgcgtcttctcctttttcagcaagacgtgcggcgtctccagctagggaactggcaaaggataacgcagcttgttcggcttctagcgtactgattttgaattcgatgcggctcacgtaacgcgggtacttatcgtttacaatcgtttgcagcgcatcatgtgcttcattccgctctgatttgaaatcctggcttcgttcacctttccaagaggtcccaagctttggctgcttgatttgcttcaggtctgtttctgccgcatcttgttcacgttcgaccttacttttcgcctttttcagtcgagcgattttttcttcgatttctgcttttttacttgtaatgccaccatttagggcagacagcatatccgataagctcattatgggttcctcctcctgacaaaaaataaaaacgctgcttagatttcatctaaacgagcgtaaggtgaatagcactttttccattattgttattataaggttcaaagactcacgtttgaatagggatttgtgccctttttatgggataaatatgctttcattctgcttctcattaccccttaagacctcttttataagaggtcttaatccctaattatttgctatatgttacatatagtcacacagacctaggacaaacaaaagccgctcggttgaggagcggcttttgtaaacggcttatgaagccgattcttctgattcttgtggattcttaacgtaccagatgaatttccctgtatatccataaataatagcaagagcaatggcaacaaagctcaaccacataaatggtaaataagagaatgtggatacgcctagaattcccgccatataaatcccgttatctgaccaagggaccataccagacgtcattgttccaccgacttcagcgtttctagatagaacgcgtctgtctattttcaatttatcgtagcttttttccataattttcggtgtaagaattaatgaaacgtacattgcacatccaaaaatattggcaaagaatgctacaacaagtgtagatagggttacatttcctgcattatataatttcttctcaaaagtagagacaatcacttttagaactcctagatattcaagtacgccaccaaacccaagcccgagaataatgaccactaaagatccaagcatattcacaataccaccacgatttaacagcgtatttaagaaatctacatctgaattaatagagaagccattgtatgctgaaccaatcgcatctgctggattcattccttggaaagccatcgcccaaatagatcctaaaagagcaccaatggcaataacaggcattgaaggtttcttaaatacgagcagtaatacaaccactactgctgggatgaccatccaaatgttaatggtaaatgtatcatgcagggcatttttcaaaaattctaccttattttgatcaatgttgcgtccaccatacataaagcctgtaaccgtaaacataatggccgtaatgacaaaggctggtatggataaaaccatcatcgctcgaacatgtgccagcacgtccacttttgaaagagaggaagcgagcactgtactatctgataatggggataatttatctccaaaataagcaccagataagacggcacctgccacgatcggaagtggaatacctagcccttcaccaattgcgatcatcgcaatccctgccgttccaaccgtcccccaagaggttcctgttgcaatggacatgagtgcacagatgacaagtgtagctaataagaagatattaggatgaataaattctaaaccataatagattaacgtaggtacaaccccacctgcaatccatgtaccaacaagtgcacctactgcaattaagattaaaatggcttctaaaccattcgatatcccttttgtgatcgcattttgaagatccttataggaatgccccaatcgaatacctaatgcgataaccataaaccatgagataaacaatgctagttgaatatccaatttgaaataaagagtaaaagataaaacaattgctaaaaacaagccaagtacagacacgacttctaacatagacggcagacgtggtgatttcattgtgtttcctccctttgtgtacgcgttaagcgttttcaaaatattgtgaaaaaagtgtgtcaattcgaaagaaagtgaattgcctgtttttctctatttcacaggcaattctacatattaataaaataaaatttttgatattattatcgctctaggagctctgcacccgcaatgccaggctttgtcatctcgaatggattcaaaataatatcaagttcttcttctgttaacacatcattttgcaagcaaagatctctgatcgattgtcctgtcaaaatggcttcccttgcgattctagccgctgcttcatagcctaaatgaggattcacggcagtgatcacgcctgcgcttttttctacatattctttcaaacgtttttcatttgcttcaatgtccactaagcaatgatctgtgaatgaacggaatccgttattcattatactaatagattgaagtaagttaaagaccaaaacaggctccatcacatttaactcaagctgacctgcttcagaggcaagacagatggtgtggtcattcccaatgacctggaatgcgatttggttaatgagctctgccatgactggattgactttcccaggcataatggatgatcctggctgacgagctggcaatgcaatttcagcaagacctgcacgcggaccagaagccattagacgaaggtcattggcaatcttagacatgttcatcatgcatacttttaatgcggcagagacttctgtgtaagcatctgtattttgcgtcgcatccacaagatgctctgcgcctacaagtggaagaccagaaatatcggctagcttcttcacgacgatctcaatataacgaggatctgcgtttaagcctgtcccaactgctgttgcccccatattgacttcatataaatgctgttttgattggttgatccgcttaatatcgcggctgagcacgcggctgtaagcttcaaattcctgtcctaaacgaattggaacagcatcctgcaggtgcgtacgtcccattttgatcacatgatcaaattctttcgctttcttttggaatacgtcctgcatcgtttgcattgtctcaagcagaatgtctaactgcttcaatacagcaatatggatcgctgtaggaaacgagtcattcgttgattgtgacatgtttacatgtgtgtttgggcttaaatggatgtattcacccttttgatgtcccatgatttctagcgctctgtttccaattacttcattggcattcatattcatcgacgttcctgcgccgccttggattgggtctacaataaagtactcatgcagtttgccttcaatgacctcatcagaagcttgtacgatggcatttccaattccttcatataaacgcccaacttccatattggcttgagctgctgcttttttcacgatggcaaaggctctaatcagttcctcgtgcatgcggtatccagttatcgggaaattttcctttgcacgaagggtttgaactccataatacacgtctgccagaatttctttttctccaagaaaatccttctcatagcgataagttgcttgaaccatctgatatgacctgctttctatagaatagttaaatcactaaatcttctgcgatcggcgtttccataatctttttcacttctcttgggtctgttgttttacctagtgcccacatgagtttcggcacaatggcctctgtgttcatgtttcgtgaacgtgccactagttcttgattgattttgcgtcctacttcatacacgctcatgtcttctccttcttcaagacactgagttgtgatgacaacagaaatgccttcttcgagcaattcgttgattttctctaaaaggtttcttccttcgaaaggaattccgccgctgccgtagctttcgatgacgactcctttgtatacacctttgattgcatctaagaatccaggctttagacctgggtgcaatttcaagagacaaacgtcggtgtttaaggatgcgtctaatttaagcggtttcattgacgatctttttactttgctattgtattcaatttgatggttttcaatcgatgcaatatatggatagttaatactttcaaatgcatcatagcttttcgttcttaatttgattgcgcgtgtcccttgaatcactctgccatcaaagacaacatacacgccgcctacgccgtcacatgcaaagcgaatggcatcggtaatgtttttctttgcatctgttttcttgaacgtaatcggaatttgtgagcctgtaatgacaattggcttatccggattttgcagcatataagatagtgctgctgatgtataggccattgtatcggttccatgcgtgacgacaaagccgtcatattgatcataattttcataaatggctgttgcgatatccacccagtattcaggctgcatatttgtactatctatactcattagggactttgtgtccattgtgtaatctgcattaatttcgtttaaatagcttaaaaggtcctcagccttaacacctggagccaaaccattttcactctctacagatgcaattgtccctccagtggttaaaagcaataatttcttcaacaggtccacctctttcagtaaaattacttcgtttgtcacacatattataagccagcttgtgctattctataatatacgctttacgcgtaccttcattgccattatagtcacataacgcgaattaatcaagaaattattacgcataacgcgtacattctattacaaaatatgatatactgttgttgtatataaaggagcgttcatgtaatgatactcgatcgtttaaccactcttagaaaaaagaaaaaatggtctctccagcatacggcagatcgcctaggtatcgccaaaagcacctatgccggttacgaatctgggtaccgacgaccttcgcttgaagcagtgaagcgcctggctgatttgtatgatacgtccattgattttttacttggtagaacggacgagccagagatacaacgtaaaatctctgatatcaaaattgaactgacggaagcaaaagaaggaacaatccttgtagacggagttcccctaaatgatgaagaaatcaaacagcttgttgcctttattcgggcgaaaaacaccctaaaagtataaaacacagaaaagagaggcccctattaatcgggtgcctctctttcctttttcagctgcttaagaataaggagaagacagctgacttaattcctctaagcgccgtttcgcttcttctttattaaatgaactataatagcgataattctcatcatctaagatgcggtaatgctgactcagcacattttgctgaagacgaaatgtgccttttttgatagacgtccgccaccaaacctttccgccgattgtacgttccaccgatagatgcaattcatcatgtgccacaacttccagaatctcaagcggatcatccccaagtgtcccttttaaaatgtcactgtccctgaataatgcacatacggccgcagtttgcgtccaattgaggcgaagcctgtttttttcaacctgctgcaaatgccgtttcgataaaccaagtacctcagccatgcggtcctgcgtataattcttttcttttcgaatccgtgccatttgttctgtgacgaggtcgattaccatctctttatccatctctcatcacctctccgagtgttcagtgtttactgacatcatacacgattttttcgaaaaagtggcgcctcatcctttagaatattggaaaatactacctagttaatctgctcttcgacctgaccatgctgctgtctccagctctcttgggctgcctgatttaaatgtgggtagatctcttgtttgacagtttgctcgaatacttcttcgtctaaaatactgtacgctggaatcttaatcaatttcccctctattgtccgaatgagcacatccatgaagagaaatcctcttacactgtaccgatgcctgcgcatatcaatggattgaatgtcatgaaaagggatcgtccgctctcgatgcagaacagcaccattttttccgcgctgaatgcaaaaaatcacgtttcccctcttcgtaaaagccggtagaatcatcaaaaaagagatcaagccatagaaaatgcctaatagtccgcctaaaaataaaaacaatgtataattcgattcaaatgtaagagcttctgaaaacagccaaataccgatgataccgaagccgcccgttgctaagaatgcccatacccttagaaaggtcctgcttctcacttctattacatcacttggattcaagcgtcattctccttttctccattagaatatagaacgtaatccttctctataagccgtctccacgcgaaattcactttcttttattcccgacacaagccacgactgtttctcacctggaatgacaaataacatggattccacatcaggcgtattatttttgtcgtagacgaccttcattagggagtccatctttccttttctcttctgtacatcagaaacaaatgcctgcacgagttcttcgttctctgctcgatgaaggaaggagggccactcattcttcgcctcacttgcttgctctaatagcttttcaaattcctctgcttgcagggtaatgacagattcagggtgatcactcatctttatgttgaaaaaggccgtcacttgcttctctgcctgctggtcgtctttcagtttttgaatctgatggacttgttgatcatacagcgtatggtgcgcatatacgcccatctgtgtcgtatgaaaggaggtactgacttcttcatcttcatccccaaatcgagacgccttgacggtgtgagatgcgtcattcatcgcctggatgaaatgacggtattccgctttataacgatattgtctgtttcgaaattcaagtacaccttttgcgagcaaagagcgacatgcaatttcaaataaaaaccctaggcgctcgtcctctacatcaggataataggcttcctttaaggacatgccttgttcaaaatagccttcactgtaaaaactaaagatgagttcctcaatacttagacttagctgatccaacttgatctctccttatccaaaagaaaatgcacccttaaagaaatcgcctgcaccttttatgagcgaatctgcggtttcttttgttttttctatccctttatgtatcacttgatttgcctgatcaatggtgtcattaactgctttcacaccttgacccgccagctcgaatgcttgtttccctttatccacgaccgcatgaattgggtcctttaatttcactgcaacctgctcagcaaagcctgatgtcagcttggcgactttttctcctataaatccaccgactgcggaaccaatggctcctccaacgacggttccaatcggtcccgcaaagcttccaagagctcctccgacaacggcacctgcgacagacccgccagcaataaagaccgtattgttcactgcatttccaacagccttcgcattttcacgcttaaggacttctggctgatcaccgaattctgcatagttctcggcaattttcaaaccacaaccgaccgtttctgttgcgccagtgacaaccgttgcaatgatggcatttcctttggcgaatcttgatccatttttcaaaacagacttgatcgcagctgtgtccttccaattgatacttccttttgtaaagtcacggacactattcgtgaatgcaactgtatcgtcaggataaaattttgtgaatttcttatgaaccaaatcagccatcgaccagtttgatcgttttaataattcttttttactcagccaaatccttgctagtcggtcaaatctcgttccttctacccggctggtcagatcaagcagcagctttgaatgctgcgctgcataacggccattgtctttaatgaaggtcgtcatcccaagcccgtagtatttcgcctgcatcatcacaataccagctaagctcgtgagtgtaccatattgatcatagatactgtacaacttccgtaaaatatcatccgcttcgaccattttatcttttgcatgacgaatcgcaatatcatcactgctcaatttactgatcaacgcttgtcctgctccccatgcatccccgacgcctgaaaaacagcttctataccgaggatcacagcctaaaatgagaccatccagttcactatgtaaatcgcggtgcttcgtttctatgacagaaagttcgcctacaacatcattcgccagccctgtcagctgatctggatcaaccactatgtcacgtgccatcacatcatctcccttctcggtttctttctctccgttcttctcgtctctttcgctcaagctcttccattctggctatttcagctttccgttcctcgattttacctgctgcatcgcgcagttcctgacttgtttcaagcaaatccttttcgaattgatcatagcgtgccgttgtttcctcaaagctttgatcaaatttattccttgcttctccctgccagcctgatcctactgccttgagccgattcacaagcagctgctttgactgccgaatctcctcagctgcttcctgaaacttttgagcgagtgccagcgtttgactagaatccaactttcgcacccctttctcccaatttaacgtacaaatggatgattttatatgtcctcattataaataaaaagacacccaaaaaaatcaccctaaagaaccattcaacacatcaaaaaatgaaagtaggtctttttcctctctaattgccagagaaagcctttcttgttatgaagcgcattcaagacgtgataaaatgaacgtattctacaaaaggagtgacgtatacatgaaagaagaaatgattcagcgattcacaagttatgtgaaggtagatacgcagtcggatgcagataaggaaagctgcccatcgactgaaggacagttgaacttagcgagacagctagttgaagaaatgaagtccatcggaattcaagaagtgacaatggatgaaaacggctatgtcatgggaacgatcccgtctaacacagaaaaagacgtacccactattggcttcctggctcacatcgacacagcgactgacttcactggcaagaatgtgaaaccgcagcttcatgaaaactatcaaggcagcgacatcaccttaaatgaagatttacatatcgttttatctccatcacagtttccaaatttacaaaagtatcaaggacatacgctgatcacaacagatggcacaaccttgcttggtgcagataacaaagcgggtatcgcagaaattatgactgccatgcattacctgatcgagcatccagaaatcaagcatggaaaaattcgcgtcgcctttacaccagatgaagagattggcagagggccgcacaaatttgatgtggatgcctttggcgcttcctatgcgtatacaattgacggaggaccgctcggggagctgcaatatgaaagcttcaatgcagcaggtgcgaaagtatccattaaaggaaacaacgtccaccctgggacagcaaaggacaaaatggtcagcgctgcgaagattgggatgctcttccataacaagcttccttctgatgaatctccggaatacacagaaggctacgaaggatttttccatctcacgaagtttgtaggagaagttgaagaagcagagctgcaatatattattcgtgattttgataaagacaaatttaacgatcgcaaagcactatttgaaaaaatagcaaatgacttaaaagccatttacggagaaaacagcatcaatctcaaaattcaagatcaatattataatatgagagaaaaaattgagccggtgaaacacattgtggatattgcccatgaagcaatggaaaaccgctcagtgacacctgtgatcgaaccgatccgcggcggtacagatggctcccagctttcatataaaggtcttccaacgccaaacatctttactggcggggaaaacttccacggtaaatatgaatttatttctgtcgagaacatggtgaaagcaacagaagtcatcgttgaaatcgcccgtctatttgaagaaaaagcatagatatgtttaaaaccgttcctgttcgggaacggtttttcaataaaagtttacaattttctgaaacttttatgacacttattcgtactaatagagacaaccccagaaaaattcttcttgacgagtgcaataactggaaatataatagttaaaaacaaccagtattttagacctaaattagcagatcacctaaaccttaagaactaaaccgatttgctgcttattttcagttataaacatcactcaccctgtctacacttaaagaataggatgaattggaggaatgtcatatgatgattttattgattatcgcttcactttgctgctacttactattctctttcaaaaaagataaccgcacaccaaaacgaaaaagcgcagagctttcggagtttgaaatctttcgtatgcgccgccactacaacggaaaacgccgtcacccactaaacgaggcacctaaacaagtataaatctaaagaaagagcctcataaggggctctttttgattgagtaaatagcaaaaaacgatcagatacagtggtcgtttttttatttatataccttcgcaggaacttgaatcatcggaattcctacatagtaaggtgaaatctcatatggttggaagacaacagcaattccctttttcgtgaagtaatactgcgtgttgtagttaatttcaatgtctctttttttcaggttcgcatagaatttgcttttatgtttctttgtgtagttataaatataatctcttacttttgtacgctttttctttgttttcacaacgtctgtcaagaacacttgctttgtctttttcttcgttagcacatagttcatgctggaaaccatcgtatcgccgtgcattccaccatcattcatgtagtcatagtttaagatactgagtttcttcccattgttaaatttcgttttaaacgatctttcgtacgtgatcttcccaaagccttcctttttcgcttcgtcctttaagaacaagtaagtagaataagagaacgcgatgtcttcttttaaatcacgattgatggttttcatatgcgccttacttaggtttttcacctgtgcatatttaaacgtttttttctttttataatagtgtgtgcttactttcgctttttttgcttgtttggcatccgcagatccaactggcgcaaacaacgaaacaatcagtgaaaaaatgagcagactgatcgttaggccttttttcattgtcatagtaaaaacccccatttttgtctattaccaattgagtataccatgacaaaagaaccaaaagaagcaatatttccatattattcttcctttttccacttcgggtttgtttaccgttttcataagttcctgtatgcttaatgtagaatgctagatgaagtgtggtgtttatcatagaagagaatatttttagtcacatccggacgacgtttcatagtttgtctccaacccagaaaaagattgccaattacattttagaaaaccctcagaaagttgtgcttcattccattagtgcactcgctgctgaatgcaatacaagtgaaacgacgatctttcggtttttacggaaaattggctatgaatcgtaccaagtgtttcgtgtccatgtcgcacaggatatagcaaccaatacaccccagtccatatacggtgagatcgaggcatccgatagtgtagctgacattaaacataaggtcatagagttaacaacaaactctattcaagacatgaaacatatattagaagaccatgccgtcacgcaattcattgaacaaatgaatcaggcacataaaaccgtcttcttcggagccggtgcatccagctttattgctggggatgcttaccataagttcctccagcttggttttgaagtgagtctatgcagtgatccgcatatgatgaacatgattgcaactcacgccacggaacacgattttatcgttgcgatctcccattcaggagagagtagagaaattcttgatgccgtgcaatttgctaaagaaaagggagcaaaggttgcctctatcaccagctatccgaaatcagagctcgcaaagcgatctgactttcatctgctcagttcctctagggagacaacctatcgatctgactccatgatctcccgtattaaccagcttgtgatcattgatgtactatacgttgccgctgttttagaactaggatcaaatgccatagaaaatgtgaaaagatctcgattagccgtagctaaaaataaaacatgaacgcaaaaggccggagctgattccggtctttttttgtgacttttctcatattttccgttgacacattcctaacacgtcatgtacattaaatggacaatagtttatttactactatcaaaaacgaaagatagtatatatactaacaaatgaaaaagaaagcgctttttgtaagggttttctataggaggcgttccatgtgacaaagaaaattggattcattggattaggtattatgggaaagcctatggcactcaatctattaaaagccggtcatactgtgactgtgttcgatctaaatgaggaagcgattcaagcgttacaaaaagccggagcaaaaggtgccgtttcagcagctgatgccgctactgaaagcgatatcattattacaatgcttcctaaaggagagcatgtagaggcagttgtttcaggtgatcatggtattttagctacagctaaacctggcactattgtcgtagatatgagctcaatttcccctgttacttctagagctttagctgctcttacaaaacagcatcaggtggaatttatcgatgcgcctgtcagcggcggagaaccgaaggcaatagacggaacacttgccatcatggctggcggcgaagaagccatctttgagcaagtgaaggatgtcctgcttgcgatgggcacagaggttgtattagttggcacaaatggaagcggaacaacagcgaagctcgccaatcaaatcatcgtcaacttaaatattgccgctatgtccgaggcgctcgttcttgctgctaaatcgggcattgccattgacaaaatgtatgaagccattcgcggtgggctggcaggaagtgctgttctcgatgcaaaggtccctctcattttagaacgaaactttgaaccaggcggacgtatcgacatcaacttaaaggatttaaccaatgtgatggaaactgctcataatatcggcgttcctctcccgctttctagccagctgctcgaaattttccacgcgctcaaagcggacggaaaatctgggcttgaccatggcggcatcgttcaatattacgaaaaaatggctcatgtcgaagtgaagaaaggatgagatagtcatgaagaaaagcactgacatactgaatgcccttccgaaaacggatgtaaagattattcaatcagcatacgaacaagcactgaacagctttcatcataaagtcattgtattagatgatgatccaacagggattcaaaccgtacatggcgtctctgttttcaccgattggtcagaagaaagcatcgaagccggttttcttgaagacagccgtatgttctttattttgaccaactctcgcagtatgacagagaaggaaacggcggctgtgcacgaaacaatcgcttcaaccattgtaaaggtagcggaacgggttgatcaggatttcatcattatcagccgaggagattccactcttcgtggacactttccgctggaaactgaagtactcagaaccacgattgaacaacaaagctcccgccaattcgatggagaaatccttcttccttttttccaagaaggtggacgcttgacgatcaacaatattcattacgtccaagaaggacacgaactcattcctgctggtgacacagaatttgcacgagaccgcacattcggctttcagtcatctcatctaggagaatggattgaagaaaagtcagacggattgttcacgaaagagaacaccacctacatttcgctagatgatctacgggctttacgaattgatcaaataaaaaaacagctcttgagtgtgaccgattttaaaaaggtggttgtaaacgctgtggactatgacgatgtccaagtctttgtcaccgctctcattgaggccattcaagcaggaaagcaactcatgttcagaagtgcggcggcacttacaaaagttcttggcggtataggggatcgtgccttattaacaagacatgacttgatacaggaagaaagctcgcacggtggtctcattatgattgggtctcatgtgaagaagacaacagatcaattaaaggcgcttcaacaaaagaaagaggtagcttttattgaattcaatacacacctcgtgctagagcctgaagcatttcaacaagaaattgaccgcgtgattcagcaaactgaagcattattagcatctggtcaatctgtggctgtttatacaagaagagaacggcttgatcttggggatgatcgtcaggaggaagaattaaagctctctgtaaaaattagtgatgctgtgacaagcattgtccagcgtctcacaattcgtcctaagtatctcattgccaaaggtggcattacctccagcgatattggtactagaggacttcacgtgaaacgcgcaaccgtagcagggcagatcagaccaggcattcccgtttggcaaacaggcgaagatagtaaattcccttttatgtcttatgtgattttcccgggaaatgttggttcaagggatacgttaaaagaagctgtagacatacttgaaggataaagcatagggggtgttttcgcgctcccttatgcaccacaaaggaggaaagatcatgtcgttagtgtttatcggacttggcgttttattattgcttttactcatggttgtctttaagttaaacgctttcatatctttgattattgtttctttaattgttgctgttttagaaggaatgtcaccacttgaagcgattgcttccgtcgaaaaaggactcggcagtacgctcgggcacctcgcactcgttctcggttttggtgcgatgcttggtaaattgatggctgattctggcggagctcagcgtattgcgatgacactcattgaccgattcggtattggaagaattcaatgggcaacgatgctgactggatttgtcatcggaattgctctattttatgaaaccggattcattatcttaattccactagtctttacgatcgcacaagctgcaagacttcctgtgctttatgtgggtatgcccctcgtcgctgcactcatcaccacacatggcttcctccctcctcacccagggccgactgccattgcaaatgtctttcaagcaaacatgggacaaaccttattagttgggattattttagcgattcctgctgttttagtaggcggacttctctttacgaagctatttaaaaaagatcagttacacgcacatattccaaagaacttgtttaatccaaaggaatttacagaagaagaaatgccaagcttcggcattagcattttcaccgctgttttgcctgtactgctcatgacattcagagcatttttagaaattttcttcccgtcctctccattactgccaaccgctgagtttttaggcgaaccggccattgcactgttaatctccgtgcttcttgctatctacacgtttggacttggcagaggcaagagcatgcaggatgtgatgaaatcgatcacagattctatcggttctattgcaatgattttattaattattgcaggtggcggcgcctttaaacaggtgctcatcgatagcggtgttgatcaatacattgcaggagtcatgcaaggaagcacactttctccactgcttctcacctggctgattgccgcggtccttcgtgtatctttaggatcagccactgtcgccggtctcacagcggctggcatttctgctcctttgattggattgacaggtgtgagcccagaattaatggtgatcgcaacaggtgccggcagtattacgttctctcacgtgaatgatgcgggtttctggatttataaagaatactttaacctgtctatggcccaaacctttaaaacgtggaccttgatggtgaccgttctttcacttgtcggactagcaggtgttctcgtcgctgatttgttcatgtagaaaattaactgtaaaaaccattgactttctctcgtaaaagttgaataattatgtttattaagaaaattgaatcaaaaggtaaccttattaagagtggtggagggactggccctgtgaaacccggcaaccgctgttccttggaacagaatggtgctaattccttaagcaagcagatgcttgtttgaagataaggcagagttctctcagtatatgatgctcttccttatccaaggaagagcttttttatttgatttttaacctgtagaaagaagggattcagcatgacacaagtacaaaccattggaaagaaaacaacgaaaccgccatttcgcgcagatcaagtaggcagtttacttcgttcagaacgtatcaaggaagcacgcaagaaaaaagcagacggtacactcacagcagagcagctccgacaaattgaaaatgaagaaattactcgtattgtcgagaagcaaaaggagattggattagaggttgtcacagatggagagttcagacgtgcttggtggcattttgactttcttgagggattagatggagtcgaaggatttgaagcggatcaaggtattcaatttcacaatacaacgacaaaagcgcggggcatcaaggtaacgggcaagatcgactttaccgatcatccaatgctggaggattatcgattccttcacagcatcgctggtgatcatacagctaaaatgacgattccaagtccgaatatgctctttttccgtggaaagcttgaagaaggagtatacgacagcctagaggcattccaccatgatgtggcacaagcgtataagaaagccatccgtgctttttatgatgcaggctgccgttatctacagctggatgatacagcatgggccgtgttcttttctgaaaaagggcatgaacaaatcaaagcctttggccgagaagaagatgaactgcgtgagtcatttgcgaagacaatcaatgaagcggttgctgatcgtccagaggatttggtgatcactatgcacatttgccgtggtaactttaaatcgacgtgggcagctgaaggcggatatgaagcagcggcagaaacgatttttgctggcttaaatctggatggtctctttttagaattcgacgatgatcgttctggcggttttgaacctcttcgctatgtgaaaaacccaaatctccaaatcgtactagggcttgtcacttcaaaatacggtgagcttgagccggctgaacagattaaaaaacgaatcgcggaagcggctcaatacgtcgatattaaccagatttgcttaagtccgcaatgcgggttcgcctcaacggaggaaggcaatctgttaacagaagagcagcaatgggaaaagcttcgtcatgtgattgagattgcagatcaagtgtggacttcatagtccccttgacgaaaaaaagacaaaccgcagtataaacggtttgtcctttttcttttatgcatctaaatgatcaccatttgtcgcaatcacttgtttataccaatcaaagcttttctttttctttctatctaatgtaccttttccttcgttatcacggtcgacataaatgaagccgtagcgttttttcatttcagctgttgatgcgctgacaaggtcaattgggccccagcttgtataacccatcaagtctactccgtctgcaatggcttctctcgcctctagcaaatggcttctgaggtaatcaattcggtaatcgtcttgaatggaaccgtcttcttctacttgatcgacagctcccaatccattttctacgataaacaatggtttttggtagcggtcatatagttggtttagtgttgtacgaagtccttttggatcaatttgccatccccaatcacttgcttctagataagggtttttcacgccttcaaataggttaccaccagtcacttgtccaagaacctctggatctgtacttgtcacaaagctcatgtaatagctgaagccaatatagtccactgtatggtttcttaggatgtcttcatcaccatcttggatctcaatatgaattccattttcgcggaagtatcgtttcatgtaacctgggtagtagcctcttgcctgtacatctgagaagaacaatgttttacggtcctgatccattgcagcaaacatatcttctggtcttgagctgtacggataagttgtcatcgctgcaatcatacagccgattttcgcatcaggaatgatttcgtgtcctgctttgacagctaaagcacttgcaacaaattggtgatgcgctgcttgatattgaatgcttttctcgtcatcaccctcttcaaatacaagtccgccgccagtgaaaggcgcatgtaacacgacgttgatttcattaaaggtcatccaatatttcactttgtctttatagcgagtaaacaacgttttcgcatatgtttcataaagatcgacaagcttacggtttctccaaccgccgtagttttttacaagtgcaagcggcatttcataatgagaaattgtgacaactggttcaattccatgcttatgcagttcatcgaatactttgtcataaaaagcaaggcctgcttcatttggttccgcatcgtcgccatttgggaaaatacgcggccaagaaatagagagtctgaagcatttgaaccccatttctgcaaagagtgcaatatcttctttatagcgatggtagaagtcaatcgcatcatgatataagtttaagtctttcattgattcatcgaatggatgcataatcccgtgcggtgatacatcagctgtcgataagccttttccatctttattataagcaccttcaatttggttgcccgcaacagcgccgccccataagaaacctttaggaaatgttttttctaacttgttcatgttgaatgccctcctcattttcttctacactgactgtgagcagtgtctcttgtactgaaatcgtgccttctgttttcgcatcaacttgtgcaaaatcgtttgtgttagtcacaataattggtgtggtgacatcatagccttcttgctgaatgccctcgatatcaaattcaacgagcacatctcctgcttgaacaagatcacctgactctacatgacttgtgaaatgttttccgccgagcttcaccgtatcaattccaacatgaatgagaagctcagtgccatggtcactctttaagccaatggcatgtttcgtttgaaaaatggtttcaaccttgccgttgaatggagctactacacgtccaactgctgggacaatagctgtacctttacccatgatttcattagagaatgttgcatcatttacttgatttagcggctttagttgaccttcaagcgggctttgtaccacttcattttgaagtgttactgtgtctttcttttcttctggtttgtctgcttttgtatcatctttcactggtacatctttgaatcctagaacaagtgtcatgatcgttgctaagacaaaggcaattactaagccgatgatagagtagacaaatgttgggccaatgaatgtcgggagacccgggagacctgctgatccagatatcacatatgattttactttaaagatcgacatgaacacgccgccgcctgctgcaccaatgagggctgcaaggaacggttttttcaatcgcatgttcacaccatacatagcaggttcagtaatacccattaatgcagtgatacttgtagacatcgccaatgatttaaatgttttgttttttgatcttaagaagacaccgaatgctgcgcctgcttgtgccatatttgctacaaacatcattggaagaatgaagtcaaaaccgtttaacgtaatgttgttgatcataattgggagtagtgcatagtgcatgcccgtaatgatcaatggtgacatgaagccaccgatcaagagtccagccaaaatacctgcatgtttgaacaataaatcaattccacctgaaaggccatttccgataatcccaccaagcggtcctactgcaataagcataattggtactacgacaagaagtgtgaccgttggaacaaggataatcttcaatgattttgggctatatttttccgcgaatctttcaacatatgagccgagccagatggtgagtagaatcggaatgaccgatgaagagtacacaacggcaaccactggtagccctagaaattctgtatttcctgcgcctagtaaagccgttaactgcgggtgcagtgcggcggctgcaatggcagcggcgatatactgatttgtgccaatttttttggctacgcttacagcaagcagaatcggtaagaagtaaaaggctccgtcgccgatagctgttaaaattgcatatgtgctgcttttatccgatatccactggaacgtaagcataagtgccaagatccctttgatcataccggcaccagcaatggctggaagaatcggtgtgaagacaccagagataaaatcgaaaagcttagatatcacattttgttttgacgcttcttctgtaccgcctgattttacatctgttgacaggcctgagtcagcaatcatcgcttgatagacatttgaaacatcattgccaataatgacatgatattgacctccgctttgattcacacccatgaccccgtctgttgattgcagcttctctttatccgcttttccttcatcgtataagttgaagcgaagtcttgtcatacaatgcgtgacttgctttacattcttttcaccgccgacaagctctagaacttcttttgctgtttgtttgtggttcattgtattaccctccaatcgttgattaaatcatgatatagaaaaaacctaaacatccattaatgtccgaaaaatagcgattcagacattaatcgatatttaggttttgcctgcttaaccagtaacaatccttcatagcgattgatcgttatttaatttttataagtctttggatacaaaaaaacctaaatcacgccttatcaaagatagggacaatgatttaggttttgcctgcttgaccagtaacaatcctaaaagattgtgggttatgttgtttatagttataaagtatcatgttaattttatgatgtcaacgctttctttttaaatttattttctttttatcactctgtcgatatgcaaagttaaatatagcatctcatcttctatgagacttcggttgtgttctttttgaacataatcgttaattttctcagcacattggaaagctgcagtgtttttctcttttacgacttcatacaggaattcattttgattttccatttgtgtttcgttaaacagacgctgtccaaaaaacttcaaatgcgtgacaaaacggaaatagtttaatgattcctcgtctaaatcaatttgaaagtgatacttaacgatatttaaaatatcttgaatgagtttggtaatttgaattacgttcggcatttcttcattgagctctgcattgacaatatgcatcgcaataaaaccggcttcatcctcaggaagatgaatattaagcttgtcctgaataatcagaatcgcttctacaccacacataaactcatctttgtacaaccgcttaatttcccatagtagggcatttttgatgtccattcctttttgatgacgttcaatagcaaaggtgatatgatctgtcagtgttacatagatactgtcattcaaatttttattaagggttgttctcgcatgatcaataatcgcctcacacacttgcatatactcgattggaatatcataaagcagggttttgaatttttctgatatatctttattttgaatggaaaatactttttcaatacgttcttcgtcaatcgggtctccacttttcttttgaaaagcgatccctctgcccataatgaccagctcatgctgctcgtcatcatacgcactgaccacattattattgattactttcgaaatgatcaattgataccccccagtacattccgctttttcgagcatctcattgttgattgatatgtcatgttattattattttcaaaaaagaggactttaagatgattttacatttttttttgatacggtcaactagaaagaatgacatattacctctcaaaaatgacgaaataggggcaaaaaagtctaaaaacatacacaaaaacactctataaagagtgttttttacaaaatcaggagcaatcccaattatagacgacattctcgaaattttttcgtttgaggtcttctggtttgataaaaaagttggcgattccgcaatctccccacagcatatccacttcatcatctgagtcgatttgtaataacagaacggtatgttcctgatcttcgtaggtacgcgggtcctcttgtgtaaagcctggatatccacccaatttgtgaccaaagccactctctgtttcataaaattcatctaacaaagcatccgcttcatctccatcaataccttcaacatcttcgaataggtcccagctccgcttacctgtgattttctcaaagcggaaatctcctacactaatcgtttcacttgatcgttcacctgtaatggcgccttccttcgttacaggaaaataaaaatcatcaggaattttcacaaaagaaaaatcagtcaacaactcttcttctgccaagaaaggttcctcaataaatttgatccgaaaatctttttgctctgttttatggtcaatattcatcccataaagatcatcatgcacagaaataaaaatttgcagaagtcctgtttctggataatctttcagcttcggcagctggccaaaattaatttgtgccaaaagcttcatagggtgtccttcaccatcaactggatattcgtcgtttttagggaagtaaggatcacctgcaattttgctgtcgtatggtcttgtttttccttgtttcatctttagttgaatcgttggctgttcagtttgatctaacattttacggtaaggtgctatgatttcttgcagcttcgctgattgtgtcacgatggtcttcctccttatgtatgggtctactgaccagactagtatctctttttctatcatacagaagtgtaccctgcctgtcagcgataaatcggtcaatatcctaacaactttcccaccttaaaacgaaaaaaacctccattttatttggaggttttggtcaatctattttttatttcacttgataattcactaagtcttctgcgagtgatttcatcgtttcatttgtttcatgaaggccttcaataatttttgtgaacgtgcctacaagctctgcttgatgctcagaagaagcgacaatttgtgctatttcttcttccattcctttaatcgatccctgcacatcttttaacgctgtttcaatatcagtcgtcgcttgtttcgcatgagttgacagctttctcacttccgttgcgaccactccaaagcctgctcctgcttcacctactcttgcagcctctattgatgcgttgagtccaagtaagttcgtttgatcagagatacctttgataagattggacacttgattgattttagaggaattttctacagtggttttcgtgttttgtagaatttgttcacttgtcgcttgtagttcctctgaatgtgcagcaacttgctgtaccattgcgactagtttttcggaagcttggttgctctctgtcatgatgtcatctaatcgttgttgattggtctggtcataggccacgcagaaagcagcgactacttgacccgtttcatctttaattggaacggctacaatatccattggaatcccgtatacttctttcggaatttgaataaacgatggctctctcccatttttcaacatagaaaagttttcgaatcctggagctacgatatctccagctttaaaccctaggtcaatgtttccgtgttgctgataataaagaaccttctctttccctaaaacagaaaaggttagttgctctctcatagctagtccaatgattggtaaagcgtctattatgttatcaattttctgtgacattcgctcacgttcatcctctctttttctcagtacatcctctttatcggttcgttataagatctattacagcctgtaatgtgtactaatatcaatcaaatgatctaagacatataaaaagcccacattctatcaagagaatgtgggggtttttaaaaaaaggtcatgcatatcaagacactgataacgatgagcaaaagatacatatagtcgatccacgaagtgctgatgacatgataatacgtccgctccctctcacccgtgaagcctcttgcttccatcgcaatggccaaacgttctgattttcgtacgccctgtgtaaaaagtggaagtgcataacgcataaaggctttccagctgtttttttgcttatagcctctgattttatgtgccgccttcatttgctttaattcactttgaaataacggaataaaccggaagccagcaagcattccatacgcccattttggtgacattttgcactgatgaatgaggctcatcataaatgctgtcaaatctgttgtggacgtaaacaaaagaccgaatgtcacaaagccaagcattctgagagcgatggtgagcccatttcttaaactctcctctgtcatatgaaaccatgcccatttccaaacagtatgatcccccttgccaaaggccgccatcatccaaaacacgagaataaaaaagagcagataagggacaagccttgtgaaaagatacttcaaattccatccgcctaagacaagtccaacacagagtgcaaacagccagatgatgaaggttgttttaggatcagatatcgccatgagacaacacattgcaagcagatgagcgagtaatttgatgactggattcacagtggaaagaaaggagtgattactttgcaatcgtcagcacgtcctttctttcagccacatagcgataatgcagcggggctctcagctgataagcatcgacaaggtcctgatttgaaaacaaatcataaggcgtgccatcatacacatgctttcctagatgaaaaagaagcacttgatcggcacactcatcgacaaggtccatatcatgtgtgaccattaaaattgtggtaccttggcgttgacgctctttcaagcgcctgattaattccttcgctgttctttcatcctgtccgaaagttggttcgtctaacaataggacatcctgatcaaaaaggagcattgtggccacactcaaccttcttttttgacctaagcttaaagtgaatggatgagcttttgcatgtttttctaaaccgaactctttcaatagctgaattgttttttcttgcacaacggattctggccaattacgctgccttccaccaaatgcaatttcatcgaacactgtatcttgtatgaattgaagctccggattttgaaacacaaagcctgctttttcatatagttctcggtcagaccacttttttaggagtgtctcttttaaaaaaatacggccttttttcgcaggctctaaacgaaccaaatgtttaagacatgtacttttcccgcttccattttccccaatgatcgccacccaatcccctgctttgatatcaagctgaagatcattcataatcctttttttcccgtagcttaattgaagatcttctgagcgaatgatggtctcacgctcagtcgacggcacttgtttatgctgctcttttctcgtttcaaaggtttgcttaagcgtgtgactcatcggatgaaatggatcttgaaggatcgtagaccatttctcgggaaataatttcggccgccaaattcctgcctctttcatttctttttcatatgtcacgagcacatcttttggagaaccatctgctaaaatgctgccttgatcgtctaataaaatcacccgatccatccattcgatgacaccatctaacacatgctctacaaaaatcatcgtttgccgctcatcagttgcaagctgctgtagaagttgaaatatctccattctgcctgctggatcaagctgtgcggtcggttcatcaaagaacagcacatctggctctaatgctagtaaacaagcaagcgccaatcgctgtttcatgccgccagataatgtgtgaatgtctgtattcggatcgacatcgagttgaactttttgcatgagctgctgaatgatgccatccatctcggcacgagggacggagcggttctctaagctaaaggcaatttcttcattgacgcgatgcatacaaaactgggaatcagggtcctgaaacatgacgcctgtatgtctttgcaatatcacttcaccctgcatgtcagcttctaaatgttctggaatgatgccagccagaacggagatgagcgtggatttaccgctgccgcttggtcctaaaataagcaccttttctcctttttgaatggaaagagagatttgatgcaaaacgggctgaggctgttcataaaaacggacagtgagattattgcacgcgagaaatgaatccatgctgttcacctttgtttcgtttttctttcatgatggcatattgatttagtacaccggttttagataatgcgtccaccactactttcgctaaacatccgcccagtatcattccgctaatgatttgagtcatcagtgtgatgagtaaaacttgaggcgtgtaataaccaaagccatttgcgacgaggctgtaagccattgctccaacagctgcaaaggcacctgacagcatcagtgtccacaagcgatattgtttataaccaaaaagagcaaaggcgatttctgccccaagtccttggcatacaccaatcagcagggctgaaagaccgaagtggctgcctgtcaataattccacagcggcagcggctgtttctgcaatcagggcagctcccggcttttggatgatatacgcgacgattggactggcaattacccaaatgccaaacatgatgttgcctcctgctgggccaacaagtgctgtaatgggtaagtaaagtgtggaccaccctaaatagatgacaccacatgcaacggataaaatgacagcaaggacaacttctttcatcttccatgtcatgatgaatgcacctccaatggaactggccaatcttccaccgtaaacgccatgtcccaaaacttgtactcaagctgacagcttaagataaagtgctttttcattttttccttttctttctcacttgctgcttccgccagctgatcgagccgcttgcaaagctctactgtaatagagtcggttagccctccataaaatgtgatccattcataaaacggatgtgatgggtcaggctgcacatctgcgagcattcgttttccaatttcccaatatgtccaagggcatggaagcaggacagcgatgatttccccaagcgtgccttccttggcgacttgcagcatatgatgaatatagtgatgagcgctcggagcaagcggggcaccttggagctcatcataagatacacctgccactcggcaaagattttgatgagggtgtgtctcgctatctagtacaaacgcaatctgctgatggaagaaggaaatatcttctttgtctgcacatctgctaagagccgctgcataaattttaataaaagcatgtaagtattctgcatcttgtttgacgtaatgaatgatctgttccttttccagctttcctgctgccagccctctgacaaacggatgctgataaatagcttcaaataatggttctgtttcttctcttaattgcgctgaaaacgtcataaaaaaaacctcctcttcttcagttgaataaatgaaaaagccaccccgaatggagcggccttcttatcaattcaatcatgaataagacgaggtccagctccacttccctccgctagtacaaactagatcaggttcaaagggtccaagatttcctcttgtctcagtcatacatgactcccctagtggacttttgtcatttaattatctttactctacacatgtggagatttgctgtcaaccgcctttcttaattcaacgttctgatcgtaggcagcttttcgatccctgcagcatagtaaaaattaaggacactgaagaaatcaattggttttcccgttttcaaatcaacagctaaaatatgatcgccgtaatttgtcatatcatcaatatctaaacgccttggcgttgtcttcccaagtgtatcaacaaagctactatggtagtattgcccgctagcaaacgatgattcatgatacataaataacgtctccacatctaagtagacgagaatagcctcagatgaactcgcataaggagcagagtacgatactggtgcagaaatacttttcactttcacactttcaacagaatgggttctctgatcatattttccgtcatatgaaaaataaaatacacgctcccatttataatcggcagtcttagattgtttgttatacactttagtcccattagcgaaaacatccccattcgcatactcagctacaaagtattgcaaggttgaggagagggaaacagccccagtgaaattgggtgggttttttgcattcacttgtaacgtgtaagagtctccgaaatctccaccgcttgtgataccgaatgcgtagtcacctgctggtaaattggtcaaaccaaggagactgcctgccggctgaatcaagtccgtcggataagcttgtccagtttcataatcaacaacaaataattgtacgaaataatcgggatttgaagaggtaattcggctgatgagtgcctgaggtgaagtcgtacttaacaaccataaatcgactgggtcattttctgataagacaaccgattggttgatggctagtccatcaatggagcgaacagaagatgtacgcatctgaccatctttagcggcttttcgtttgatactgattccatttttcttatctactttaaaagatttttttagctgcttcttttggatagcggttccttcatcctgtttcaaaaacgagtcttgcacttgctgaatggctttttccgtcagtggtgacaatttcccatctgatttcggtgcttcttctgcttttaatgttggtgaaaataaacctgttgtgacgagtagaatggataataaagctgcagtgatttttccaaaaattgctctcacaggaacatcccctttttccttaattgggttttataccctgtgaatattttaccattgttttattctatttttggacttttttaggaaatttttatgacaaaaaaaccagccgtttttgctacgactggttttttgatcactttatgaaatggttttaacaaacaggcgtgctgtttctgcactagaccctgggttttgtccagtaatgatttgtccgtcaactacagcgaatggagcaaaggcatctcctttttcaaacgctgccccttgctcacgaagttttgtttccagtaaaaatggaacttttgatgtcagctgaacagcttcctcttcttcgtttgtgaagcctgtcacttttttaccttcgataaatgattttccatcttgatccttcacatcaatgaatgctgaaacaccgtgacaaacagctccgactgcaccatttttgtttgaaatagctaagattgcatcagctaccagttgattagacgcaaaatcgatcattggaccgtgtcctcccgcaaagaagatgccatcataatcagctgggttcacatctgtaagcgcctttgtgtcttgaagtaattcatatacatcttcatattgcgctggaacaccttctggaattgaatttttatcaatcgggacagttccaccttgaatagagactatttgaacatctagttcattttctttaaaaatatgaaacggctctgccaattcttctagccataagcctgttggatgtccgttcatttctgaactgcttgtcgatactaataacactttcttactcaccttgatcatcctttcgatttatcatgtggctattttacattttgcacaattaaatatcaagcaattgaacttcgatgtaactctttatggtatacccgatttactgaaaattatggcatgacatcaaatctaatcaatatgtcacattctattggcagggaatttcatgtaaaattgtcattgagtgatatcatatgaagtaagatggatagacctcacggatgtaaggggacttttaaaggagtggaaaagagatgaaaacctattcgattgtgatgatcatcatcacgctctgtatcatattggctgtctttttgatgaacttaacaggggtcatgtatggaaaaattattttggctgttgccgttgcactatgtctgacatccattattcgtctgatgggtcttcgaaaaagataaaaaccgcccttcactagagcggttttatttatggttaaattgctaggataagcgcaattaacgcaagaagcgctggtactccttgcttgacaataattgatttattagaggtcacaccgccaaataccgcagcgatgatcacacaaagaatgaaaaatagctgaatcatatatccaacagtattcgaaccgagaatgagcccccaaatcaatcctgcagctaaaaacccgttataaagcccctgattggcaaacatcacttttacatttggatccttttgcaagtgttctggcagcttaaaggatctctttgccatctttgattccataaaaaacatttctaataacataatgacaaggtgttctaatgcgacaattcctactagtattattgctaaaatattcaatttagttaattcctttctgatagacgatcacgaatctctattttatccgtgtataaatcaaagtcttgtattaattcaagcgcttcagtaaagcggctttgtggaatgtctttcattttcctcacaccaaactcctttttaataaaagccatgatggtattgatatgaagcttaccgtgaccatcatactccaaatggctgcaaaaagtctgcatcgtccctcttatcacctttaattgcttagcagtgacacaactcattggtaacgctcatcctttcctttgttttaacagctaaaaagaaccatgtatgaaagaaaaaccttccagtctctattatataatgatttcattcggatatcaaaataaaaaagaacagacattcgaccaaaaagccgcctttttcatcaaaaacagtttattatcacatcaaaaagccggattcaatggtagaatccggctttctatttagttacttttagaaattaatacctttccaacagaacgatccttactttgtccaacaactttaaaggatagaccgtatgttgggacgtcacgccctgcatctggattatttggattcacataattctttttatcactaaatgtacgagtcgggcgaatatagcgatctaccaatgttaagccagttgtcgctgtataatcaatattgagcttcgtacttggattcaaagaaaatgcggcatcatgtacttggaaacctgtagcagcaatggagccgtcactccacttcaatacttgctgatctgcatctactaccccaaggaaaccgttccctgggtgttttcctacccagttatcactgtaggattgatcgacataccacacgaccaaaccgttattatagctcatgaggcttgctcctcgtttgatatgctttaaccctttatcgacatcagcatatgagcgccactctagtaaataatattgtgctgcatattgttttccattcgatttcgagaatccgttaaaggtgaaagtagacgtgccctcggcatcatctgaccacactttcgttccatctgcagtgatgtttaaatcatctacaaataaccctggcaatgaatagcctgcatcggttgtgtagcggaattgcaggtcaattttcttccctgcataggcagaaagatcaaaggctgcatctacccatccgtctgattttccatcaattccattgccttcgttcgctccagcttcatttcgatcattcgtgatgttaccagcaatggtcttccactgatcagttcctgtttcacgaacttctacatacgcatagtcataatcctcttcgatatcgtaccatgctttaaatgtcagctctgctttgctccctttcgacaaatcgatacctgttgtcgtcatggtcgcatttaaattgtcacccgttccgctaaagtacgcattttgtccttgagcaggttttgtgaccacaatctctttatctggtaaatccactcgaaccgcatcatggttcgttccttttgttgctgcttcatcaatcagcactgttttgcttttctttaatgttttaccatcaatggtttgtccagtaagccagttaccaccatgcaagttttgaagcatttctttcgcatatggactaaagcctgttggttccgtaccagggactttacctgcccagcttccgcttgacatgatcgaccagtaggaaacaggttcgcctccgcctgtgtactgtgtatcgtactcatcaggaagaccaagatcatgtccgaattcatgtgtgaatacacctgccgcgccatcttcaggctcaatggtgtaatctaacgcgcctaattttccgccttgtccgacttcagattcagtgtttggaatttcaaatacatcaccaagtgaccagcggtgcgaccaaatcgcatcagagccaagttgtccgccgccagcttcttcacctacgccagcatgaacgaccatcagatggtcaatgatgccgtctggttcgttataaacgccgtcgccatccatatcatatcgatcccattgatcatattcaccgagatcaatgttcgggtcttttgctgctgcttcgagtgcttctttcaccaattcacgcggtctgccgtcactgcctgattcatcaggcacattcccgccataataggctgcttcatgcttcgctgtataccagccagcaaccgttccactgatcgtgtaactgccgccagactgtttctcataatattgcttcatggatacttttcgtttcccatctggaccaatgtagccattttttccgaaaagcatgtcttgatagtgctgttgatcgtacttgtcatagtacatatcagtctcttcttttttaatactattatgcttataatctttaaaatctactaataacaccaataccttatcattgcgaacttcgcctttatacttttcctttttgaccggttttacatgattactttcttttcctttatgcttctttaactttttctttttagctaatttgttatgtaccttttgtttgtattctttcagaaattcaggctcttctgttaaagtgcttgcactttgtttcatagcagattcttcttttttcttaagatagttctttagtgctttttgggtttccgcttcattggcattctttttgatctttccttgttttttcaaggctttgatgagacggtcttcattcacgacacttgcgtcaaatggaatacctgaataatgaccgccatctgaggatgttgatttctctgtggtgtgggcagatagaggggtgctgaaagctgccaatgtgcctaaactgaggacagccgttagtgcaatactcgtccatttcccttttttcatattggttcctccctaatttggtaataaataatatctaattctagcatattccaatatacttaagtcgaaaaacattttattttcagaaactttgtggaaaatgcacaatacgggaatgaaatgggtggaacaagctgtcgaaaataaaagaaccctaggcgataaccgcctagggtgtttgttgttttactatgaaagttgctggccttgaaaggcaacaacgtcaagtggagcggctaagaattcttttgctttcgcgacgaaagcttgaaaatgagcgctcgcattatgactctgaaccgcagcgtcatctttccacacttctaccattaagaaggtattttccttatctgtatccttgaacagcttgtaggatacattgccttcttccgcttgtgtagctttcattaatgcattgatttcttctagaaatacgttttctttttctggatgaatggtcatccctgcatgaataataatcatctaatcgtctcctttttaaaaaatattatttccactctgtaatgcgttcaatcggtaagcggtaagatgcataaccttcgtcagcagctttcccaattgataacagcatcactggtacataacgttctttatcccagccaaatgtttcagcgatgacttctttgtcatatccgccaatcgggtttgtatcatagccatgagcacgagcagcaagcatcagctgcatagacacaagtccaccgtcaattaagatcgtttcacgattcacttgctctggaagagcttcaaaatgtgcagttaatgcagcaatttgtctttcttttacttcttgcggcatgtagccattttctactgcttttgaataaatttcttctaagtattcattatttttcatatctgcaaacactgcgatgacagctgatgatgttgccacttgtgtttggttgaattttgcaagtggagcaagcttttcttttccttctgggctgtctatgaccatgaagcgccaaggctgtgcattcactgatgatggtgcagttgttgcttcttctagaatctctgccatttcttctttgctgattttcacagctgggtcatagttacgaatggagcggcgtcctttcataatttccataaaatcgtttgtttttaatgttgtagccatgttgaaacactcctttaggttgtttgaatcttttcgatgttttgttgtattcggatgagcacatcagtgagaagctttcgttcttcgtcacttacgttttcaagcatttctgagataaatcgttctttttcttttttagaagcttcgattctcgttctgccttcttctgtcagacgaacaagcgtgactcgattatcttctggctttcttctgcgcgtgaccattccttttgtttctaactgttttaagtgacgcgtcacagccgcactatcaatatttacttttttctgcaaatctgactggctgatttcgtctgcttgaaataacagtgatagcaactctagtcttgattggctgatgcccgtgcatgcttcgaacttcacgcccatcatacggttcacgcactgcaaacggtataatacctctgcttcttcagagcaaaatgcagtcaatgccatcccctcttttctattcagatcaattagttgatatatcaatcattgactcgtcaactaatatacacccattatttcatgattgcaagaggtttgtttcataaagtgaaattttttatctcaatagaaaaagacgagctgaacgcccgcctttttaaacaccatacaggtgggaatccccacctaaatcttacataaaaaaaggacaaaagcgacgaagcacttttgtccttttttctttattctgtgatcaccgtgtgaatgagagttggtgcatcagcatgatctgcgatgcggatgttgtcataaattttctccatgacatttgcaacatcttcacgatttgcatgaagtgtcacgagtgaatctcctttttcaacacgatcgccgacttttttgttcagcatgataccaacagataggtcgatatcgtcctcttttgttgcacgccctgctccaagaatcatcgctgcaacaccgatttcgtctgcgacgatttcagcaacgacacctgcttcttttgcaggaacttcgatttggtaaggggcttgcggcagtttttctggttgatctacaatcgagccgtctccaccttggttttctaagaattccttgaatttctcaagtgctttaccgtttttcatgacttcaattagcttttctcttgcttcatcaagcgtttctgcttttttcgcaagaacgaccatttgacttcctaaagtgagcacaagctcgtttaagtcttcagggccttcgcctttaagtgtgtcaatcgcttctttcacttcaagggaatttccaatcgctaatcctaacggctgagacatatcagagatgacagccatcgtttgtctgccaacgttgtttccgatgcggaccatggcttttgcaagcttctcagagtcttcaggtgttttcatgaaggcacctgcacctgttttcacatctaatacgatcgcatctgcgccagcagcaattttcttactcataatcgagcttgcaatgagcggaattgagttaacggttcctgtcacatcacgaagggcataaagctttttatccgctggtgtcaggttgcctgattgaccaatgaccgctactttatgacggttcacgagctcgatgaattcatcttttgtaatttctacgtggaagccttttaccgcttcaagcttatccactgtaccgcctgtatgtccaagaccgcggccagacattttcgcaacaggtacatcaagtgcagccacaagaggagcaagtacaagcgttgttgtatcacctacaccgcctgttgagtgcttgtctactttaatgccctcaatggcagacaggtcaatcgtgtctcctgagttcgccatagcgagcgttaagtcagcacgttcttgatccgtcatatcttggaagaaaatcgccatagccaaggcacttgcttggtagtcaggaattgttccgtccgtatatcctttgacaaagaaagaaatttcctctgaagataattcttttccgtcacgttttttcgcaatgatatctaccattctcattgttttcaccattcctttttttaaattagtaaatcaaaccaacaacgcctgctgttaagaagctgacaagtgttgcaccaaatagcagctttaatccaaagcgtgcaacaacgtttccttgtttttcgtttaagcctttgactgctccagcaatgataccgatagaagagaagttcgcaaatgatacaaggaatacagaaatgatcgcttctgtacgagcagtgaaatggaaagcatcaccggacaggatttgcattgccacaaattcgttggaaaccattttcgttgccataatgcttcctgcttgtactgcttcgctccaaggtacaccaacaataaaagcaaatggggcaaatacataaccaagtacatcttggaaagaaacaccgataacagctgtaaagattccattaatcatggcaattaatgcaacgaatccaatcaacatcgcagcaacaacaatcgctactttgaaaccatccataatatattcaccaagcatttcaaagaaggattgcttttcttcttcaacgacttcgagcatgtcttcgtccttagctacttcatatggattgataatagacgcaataataaatccaccaaataggttcagcacaagtgctgtgaccacgtactctggtttaatcatttgcatgtacgcaccgacaatagacatcgatacggtcgacattgcggatgcacataatgtataaagacgctgctgaggtaataatccaagctgcttcttaatggaaataaagacttctgattggcctaaaatcgcagacgctactgcgttgtaagattccagtttccccataccgtttactttgctgagcagataaccaattccgcgtacgataagcggaaggatacgccaatgctgcaaaataccgatcaatgctgaaataaagacgatcggcagtaagacgttgatgaagaaagttgatgccttatcattcattaatccgccaaatacgaagttgattccttcaccggcatagcctaaaagcatttggaatccttttgcaaagcccccgactaggaagttcccaacacctgtattgagcagaatataacctaaaataaattgcagtacaatcatgacaattactggacggaattttactcgttttttgccgttactagcaagccatgcaatggcgagaatcaccagcaaaccgatgataccaatcacgtatttcatgtttttcctcctcgaatgaattcgtttacattaatgcgcttgtatggaacaaaccctatttcgtaaacaaagtgcggaagaaattcccagaagtgagatccttccgcatatgactttttcattatttatgagtcacgaatgttatcctaccataggatcgtatgaattaatagtctttcgaaggagctgattgatcccctttgataatagaaacgcctgcactcgcaccaattcgggtagcgcctgcagctagcattgcatcaacatcttcttttgttctcacgccgcctgatgctttcacaccaatgtcaggtcctactgttttacgcattaatgcgatatcctcagcagttgcaccgcctatactaaatccagtcgatgttttcacaaaatcagcgccagctttcactgaaagctcacaagctttgactttctcttcatctgtgagtaaacacgcttcaataatgactttcacaagtgctttcccttttgccgcgtctacaactgcacgaatatcttgctcaactgcatcatattcgccgtctttcaatgccgcgatattgatgaccatgtccacttcggttgcaccgttctcaatggcatcctttgtttcaaatgctttcactgctgttgtgtttgcacctagagggaaaccgatgactgtacaaacatcaacacctgttcctgctagttctttcgccgcaagagacacccatgttggattcacacaaacagatgcgaactgatgagtctttgcttcttcaagtaactgcatgattgcagctttcgatgtatctggttttagtgctgtatgatcaatgagctttgctatcgtcatgcttacacttccttttatttatgatactttcatcatatatgaccgatgaacaattgtaaacatagttatgaaattttgttcatctattttgtgacatttaaaagagcctttgctgtatgctgatcaataatcaatacgttcgcatattttcctcttagtgccccgtggatagaagcaaccttgcgatgtccaccagcaacaagaatagaacgttcttttgtccttaaatcatcaagctccacgccaatcgtacggttgttaatcgcttcactgcaaatgcgtccttcttgatcataaaagcgcgaacagatgtcgccaacgctggttgctttgagcagtgctttttcttcttcacggaagtaaccaagtctaaacaaaagggcctcgtctcttaccgttccaacagtgaacacagcaatattcgcctgtttgcccatttcaatgatgcgctgaatatgtctgtcctgttcaaccatctctttgacggcagcactgtcaaatacaacaggaagcggcaaatagcggggtgctgtttgaaaggcctcggcaaacagctggatggtttccgcagaatatgtattcacatgggagtggctaatcccacccttcagctggacaacttctacacctttgacctgtttaggttgcatcttttgggcaatttgatacatggtagttccccagctcaccccaacgatatcaccgtcttttactgtgttttgcaagtactcggcaccaaattggctcaagtattcggtgatcgttggataatcatctttgggcgaaaataccacatgagcttcgagcaggtcatatttttccttaagcaatgaagacagctcattcaagtcttcaaacgggtccattaccgttatctggacgtaccccttctcctttgcatattgaagcagccgagatacagttggtctcgacaggtcgagctgtttggcaatttcctgctggctgtaatctgataaataatatagccttgccgcttcaatactcagttgttgtttctcccgatccattcgtacgcctccttttttcttctatcataacaaattgttcaaactatcatgcacaaatgttcatttaaagaaaatcgtataggcggcttggaaggtctcattcttctctaaagtttgaataccgaacttttccttgtactgcccattcgtcccttcaacatcggcaataccgtaccaaggctcaatacaaacaaaaggagccattgtgccattttcttgatgataaggtgaccaaataccaacgaacggaaaaccagtgagatcaacctcaaccccgtgacctgcctgagacgtcaatgacactcgattgatatgactaaagatcatcgcatcatgctgaaaaagttctggtcgaagctgaattggttgaagctgaatgcttttttctttctccctgacaagtgaatttttcagttcatattggacaggaagatgctcagtagaaggcgtcaatgtcagagagtaatctgctgtgcgctctccttcaacaagcgggacttggaatgcagggtggcctccgatggagaaatacatcgtgtcatccccggcataatcaatttcccaggaaatcgtcagaccattttctgatagctcgtaccgaatacgtgcggtaaattcataaggatactgctcgatgtgacggccttttgattcatattgaaaggtcactgtatgtttcgtttcttcatgtaaatcaaaatcaacatcacgcaagaatccatgctgcgtgagctcataggtttgatcacctatcttatattggtcattctttaatcgtccaacaatcgggaataagacaggcgacaccctgccccagtaagcaggatcgccagaccacatatattgacgtccactttccttgtgaagcacctctctgacctcggcacctctctcattgatttgaatcagtaattgattattttcaagtcttctcatttcacacatcccctttccatcttcttttattatgacagggattttggttttgagtataaaagagttatttataataaaaaagacttctcccttctagggaaaagcctttaaaataacttattcatcatcttcttgtatagtccatttaagacctttgatttgttttaaactctcaatttcttcttcgttttcaggaaaaatatagctctcctcttcatgtgagcttgaaaccatccactcttttccatttttgaagaatgataaatcctccagtaaattagggtgaacccacccgtatagagagttcgaaagttcttttaacaaattttttgtgtgttcattggcataataataataaacataagctgtttgaccatctcctagaatcgtggtagcccactcagactcttccttcatttctttaagagatggtgaaagtttatttagaatttcacgataatcatcaaaatcagctaaatcttttctaaaaactaattggaattcatcacatacttcacaacataaatcgatgagcgcattgtattccttgtttcttggttgacgattaagaacaatcatcgaaaacctcctctatctggatttcttatctaggagcgccaaaaaaagcatgtgctccagttctttcatatttaccttttaatttataaactggatgatagtgatagtgtttatttttgccttttttgtcaatttccgcacctattacttttccaatcggactggctgctttagcaatagattgtgcattgcttttggaagtagaccatgtatcttttttctgagctaatctttttacagcgtttgctcgacttataccttttccaataaacaaatgaggtttatctttgtctcgataagcaataaagtgattatgtttattgtctttcctttttataaattcagaataagcaatataggtaacacctactactgttactgcaagtcccaaagctaataaatgttctaatagaactgcaccaatagcaataccaataggaataacaaatgcaaaagatgcttgaatatcttcagagttcacttcatatttcttatcatcttttgtatctttaaacgtaacatctaaattatcatttataagtgtctgcaagtcaacttcataatcctttgaaaccttttcaccttcactactaatttcttcagttttataactgatttctgttgtttctttatttagagttagaataccagttactccgtcttgctcctgtgaaattatatatttttcattactatcttctaaaacatgaaaatcttttgtggtaacagcctctgttttattcggaaattggaaaaacaaagttataaccagcgatagacatataacaattgagaataacttacttattttattcatcctaaactaaacctccgagtttcttgtttatcaataccatttttttaagattttatatatttgttggtttaaactttcttcagaattaatattaaaacgttcccggtactgtaatattaagcttactacacctgtaatatgagcactcgctaaagaggtgccactttcaatcgcatagttgttatgaggtcttagaactggtatatctacaccaggagcagcaaaattgtaatttcctttagatgaaaattcagctaccttcttatgcttatccacagcggttacagaaaaaacattctcataagcagctgggtaatccattttccttccatacttattaccaacagcagctactataattatgtttctttgtattgctttgtctataatcttcttaacagatggatcatctttcattaatccaaaactagcattgataacatcaattttattatcaatacaccattgaacagctttgacaaaattttttattgaacccttgccttttgaatctagaattttaacaggatataactctacattctgtgttatacccacaagtccaatttcattatcattagctgtgattattccagctacagcagttccgtgccctaaactgtcctcttgtgctcctcctgtaccaattgtgttaagtccttttttaactttacctaccaaatcagggtgtgtcccatctatcccactatcaattattgctattcgtacactttctccttccctattattttccacatatttttttgttaactttatgctccatggaatctgttgatgaatattactagtgtagtttaaattttttgagtgcaattcaaagcacttaaaataaattaaaagaactattaatattatcaaaaatctctttatcaaactattgattcatcaccactccttttttcatatattattctatattatggtttttagtcaatataaaaccagatatgttatatattaatattttggtttacaataaaaatttattgaataaattcaaactaaatattatgcgttgacgtctattatatatacaatatatgagtaaccattattaaatacaggtttctttacaattgatgggggattcattttcatgaacagcaaggagaatcgtttacgttatatattaggattggatgggctaagagccgttgctgtattggcggtcattgcttatcacttacatattggacctgcgagcggcgggtttcttggcgttgatttgttttttgtaatctctggttacttgatcacgacgatcttgttacataaacaggatctaagctatcaagagcttttgccattttggatgggccggatcagaaggcttcttccagctgcttacgtgatgattttcttaaccgtcagctggtgtgcgattgcgggctcgaatgcactattgtccattcgcggcgatgccttatcgtcctttttttatgtcagtaactggtggtacatcttccatcagctgtcttattttgatagcttcaatgctgtatctccactgaaaaatttgtggtctttggcgatagaagagcaattttatatcatttggccggtactactgattgcaggtctaaaatgggtgaaaaatagatcccatctgccaatgatcacctttggccttgcacttgtctccgccttatggatggcgattctttattcaccagatacggacccaagcagggtttattatggaacagatactcgtgcatttgcacttctgattgggtgcagcctagcatttgtatggcccatgcacagactgtccagcaaaaagctacttcctgttggcagacgttttttacatatcgctggttttggttcgtttgcgatttttcttctatgtgtttatgcagtggatgaatttgacggtttcctctatcaaggcggcatgcttttattctgtctgaatgcagcgattttaattgcgtgcatctgccaccctgcaagcctactaggaaaatggctctcctatcagccgctcgtctggcttggaaagcgttcttatggtatttacctgtggcattatcccatcatcgtgctgaccacccctgtcattgaaattggacagccttctatgggacgtgtcgtattgcaggtcattgccattttactcattgcagagtcttcttaccgcttcatcgagcagccgattcgccggcttggtttcagacaatattttgcctcttggtctatttggaaaaagggtttcaaacaatggtctacgtctcataaagtgttccttggaatcactgcagctcttttgatcttatttaccattggcatgtccagctcgtcccatacacctccacatgccaaggaagtgacacaaattaagacggcaccgaaaaaggcaggagactctgctgaatcaaaaacgaagaaaaagaaagaaacacacgagaagaaagcagcagatcagaagcagtttcaccaaatccttgctattggtgattccgtcatgctagacatagcgccgaatcttgaaaaagcatatgcccaaatcaccatcgatgcaaaggttggcagacaaatgaacgaagccgtcagcatcgctcctcagtatgcttcatttaatcaatctaatgccgctgttattattgagcttggcacgaatggctattttactgagggcacattgaccgcatttattcagcaattttcaaaggcgcacattttccttgtgaacacgagagtcccaaggtcttgggaaaatgatgtgaatgccgtcattcagcgagtagccgatcaacattccaatgtgaccctggtcgattggcattcagccgctaccggacagccatcttattttcagcctgatggtgttcacctttcaacaaaaggctctgatacattgacccagctcattacagcgagcatcaagaaaaaaggagatgtgtcatcgtcatcataagaagactagcatcttgtgaagaaatttgtgcaattgctctactaataatagaagatgaaaaaaagacatgctttcccatgattggaggcatgtcttttttgtgatggatggcaggagcatctgcactcggagctgcattatgttttacttttaaaagaccaaactatgacaggtatgagaattaacgataaaattcctccgcttaaagataatgcagcataactcgtattcgcaacgatcattcctgaaagagcaccgccagaagcacctgctaacgccacaaaaacatcgagtgttccttgggtttttgcccgggttgatgggtctgtagaatcaactatttgagcagtaccactaattaaaccaaagttccatcccaatccaagtaaagagagagcaatgattaatagaatcattgaatcacttggtgcgaatgctgcgaataaaccagcaagtaacaatgtgatgcccgacgctatgctcatagctgttcgtcctagtttatctacaagtacacccgtgataggtgaaggaagatacatcgcacctatatgaaaaccaatcacaatgcccacttcggctaacccatgaccatgatgctgcatatgcaccggtgtcatggtcatgagtgcaaccatgacgatttgagttaagatcataaccgtggcacctactgtaagcccttttctatctattttttgatcagcagaatctcgtttatttccatgcccatgctctgctttgtaagctgctattttttgggcaatgactaacggatcaggacgcagcaggataaaaaggacaagacctgctacaataaatgctgctgctgataaaataaagggacccgcaagtgctggaacaccaattgatactgcaaattcacccatcatttcaactaaattgggacctgctactgctccaaatgttgtcatgaccattgtcatactaattgcagttgcacgttgtttagaattcgctaagtcagtcccagcataacgaacttgtaaatttgtggctgttcctgcgccgtaaatgaagagcgatgcaaatgatataatgacactattcatcatagctgcaatcacaacaccaattgctcctagccctccagcaacaaaacctgtcgataaaccgatgcgccgtccataacgttgcgaaagctttcctacaatgaaagctgacccagctgaccccaaagtaaataaagcgattgggactcctgcataggcttcagttccaagcatttgttgagctaaaagtgcacctaccgtaattcctgcggctataccagcccctccaaatatttgcgatagactgacaacgaacaatactcgtttaaataattttttcaatttttggggtgaatctatataattcttcactacatcttgttctgtatctagcaattgtaaacacccacttgagatttatttgcaaaatgtaaccattatatcagttcagcctacaatcctcgattcgaatctttttcaatctcggccatttacattgaggacaacttgtttttcaatcagatcatgaataaagctgccacatgactgatctattcttttgaactgacacataccttagagtgaagatgtcttcatctcgttacccagactagcatcctgctagtcttcttttatgccgttaaaaggctggctttcagcgctaacacacgctttcccttcgttttttgatccaccaacgcaaaatcaccattctcatacgctaatgaaaataattgttcgatatgaaacacacctgtctgaaactgcctgctcaataaatgcagtgccgcagcagaggcgacttgagctgttgcttgagactcatcatgcccttttattccaagcgctgcttgatgaatcttgttcccctccattcctgtcgcctccactttcactgcatattgatctgttcccatttgagcagattgaatcatggaaatggcacgttccttgattttcggcatagtgagaagagatgtcattccaatgcttcttgtgaaggcaaatgcccgcgttgccgcgcgagaatcaaaacatagccttgttgtcacagaaggcacgctgagcgtcaaaggcaatgtttgctgatcagagaaggggaactgataggcttgccgctttccaattttcacaccaaaatctatacgcttgcctccggtaaagcttttgactcttttatgctgatgatgcttagtaatcacatagtcagtatggacattgtcaagcgtccattcaatggcggcttttccatgctgatcacccaatccaagcataatccctatatctatttgattcactgatgagagcatagatgctgcttttgctgccaataagttcgtaagaccaggcgcaagcccgacactgagtaaagccgttgcacgggtgtgctgctgatccagctttgccacctgttccatgtacgaccctttcgcagagatatctatataatcaatacctgaccgcagaactgtttcggcaaatgacggatcttcttgatcaaggcacatgatcaccagttttgtttgatccacccagtccgaaaataacggctcactgacatctagttgatagggaagaactttcccttttgtctggcgtgaaaatttctctgccttctcatagcttctgcctgccgctacaatttgcccgggatacacttcgcttagctgaagacatatttgctttccaacatgtccataaccgcctattaccatcacctgtgatctcatttctcatccgcctctctacgacctcgcttgcaaacaagccccttaatcattcctgcctgaaaataaggtctgatgtcttcaaatcctgctttgattaaatgctcttttatttcttcatcgggaacagggtgtgtcccagcctgtttttaaaggacgtaaacacttctttttctaggccttgtcgctgcatgaaaagagaaagcatgtgaagctcctgttgaaatacttgggacttcaactctccctgtataaatgccaagacaaacggcgcacctggttgaagcctgcgggcaacctcctctaaaaagggctggcgcttttctataaaatgaatgacaagcaagctcaccgctgcatcgtaaacagtttcagctgaaactttatctaatgaggcctcatgccatgtgacacgcgcctccatctcaagctgtgcaactcgctgtttcgccatgtccagcataaaaggtgacggatcaacccctgtgatgagccagtcttcctttctttgaagcatgttgatgatctcttcgcccccgcccgctccaacagtcaggatgcaggaagccgctccctttaattcagtttctaatacgtctattgtcaactcatgcaatagctgatagccgggtactttatgggcaatcgtcgctgcatatgactcagcaacgggatcgtgccaatgctgatttcctttcatatccttctcctcagttcctttccgctttacatcgtttcctgtacactaacggtatgacatctttattgtaaaaagagacaacagaaaacacgatccctaaaagtggggatttttgaggaggagatcatgtgaccaatccagccactcattttcagcagctgagacagcacattcgggacgaacttgctgccgtccttgattttgatgccgcctgtatcacgaccattgatccagccactctcctctcgacaggttccttcacagatgaaccgattgaagagattcatgaccagctgtttcaaaatgagttcttaaaaaaggacgtgcatcagcatgagactctagccaaaggccctgttcatgctgctagcctagtccaaagcggggaatatctcgacagtgagcgctaccaagacattttgttacctaaaggatggtctgatgaattgcgggcagctcttgtgattcaaggagaatgctgggggattgccagcctctatcgtctaaaggacaaggaaccttttcaagaaaaagatatccgagtggtcatcgaacaaacgcctagactcgcagccaagctgagagatgaacttttcaagaaaagagatacggaagaggacgcggcggcggagcagcaaggcttcctcattctctcgcacgattacaaccttctttatggaaatgaaacgggtcttcattggcttcagacgtttcaagcctttgaacaaatccatgacaaggcgattatgccgcgcccgtttagagcattaggggctaaacttttatacggcggtattgagcaaacagcggcaagtatgacacgattgcctacggggctgttcctctctcttcaagcatttcgattaactcaggcagcagggcaggaagaagctgtcatgattcacatcaagagagcccaaaccaatgatatttttccttatgcggcaaaaacgtacaagctgacagaaagagagatgaacgtcctagactgcttattaaagggacagtctacaaaggaaattgccagtactttatttatttcaacccataccgtccatgaccatgtgaaggcgatgctgcaaaagacaaatttgagcagcagacggatgcttgtttactttttctctcacatttaaaaaagcggctacctcactggtagaccgcttttttgtttattttcctagaactaactcatgcaggatatgggcaacgccggcttcattattggattttgtcacaacatccgctactgatttgacatcatcaatggcatttcccatggcaacgccgcagcccgcaaattccagcatcgatacgtcgttcccattgtcaccaatggccatgacctcttcacgagcaatccccagctctttcgctagaagcttcacggcattccctttgctaacttcaggatgcaggatttcaaggaagaaatctgtgcttttcaccatcatgtacttgtcttttacttcagatggaatggcttgtatcgtcttttccaaccgttctggctgatcaatatacatcatcttcggaagtctcattgatggatctgcctcttcaacaggtaaatatttaagcggcagctttgttaaataagattcaagtactgtgtactcactaatatcacgattcggtgtgtacaaatgagcggaatcgaaataatgcatcggtgtatcaagctcacggctcagcttatataaagaagttaaatcctcataggataacgtcagttctgacactacttcatttgtgtgactgttttgaacaagcgccccattgtaggcaatcacataatctccctcttgattgagctgaagatcatctagatagcgattcactccgccaataggccgtcctgtacataatacaattttaacgccctctgctttcgcctgttgaatggcttcaaacacctcatccggcaccatatgttgatcatttaataacgtaccatccatatcaattgcaactaatttatacattcactggtccccttttctcagcaaaaacgtgctgcactattttgagccatcatctatatgatgacaggttatatcattactatttacctattttagcctatcgttttttcatcacgctgtctacttgttctcacctgtaacaaaattgtcatatgccttctctattatatcgtattctattcatcctgctttaaatagagtttctgcccttttccaccgtgaaaatgaagacaaatgttcaccactgaatattttgaaactagcaaatctaattgtatgatggatagcaaagaaaggaggtgcagggaatgattacttttactagaggtaaattgtcaaaaatgtctggtgtgcatattgaaaccattcgtttttatgaaaatgagggtgtgctccccgaaccaaagagagcacacaatggctatcgtttatatgataaaaaatatgtactcatgctatcctttatcacagaagctagaaagctagatttctcactcaaagaaattcgcgaaattatcaaatcgctatttgaaaaacaatcaaagacagaagctgaacagctgctcgaacaaaaggttgaggatattcaacactccattcatgagttaaagaagaggaaagctgccattcaattgttaacaaaacaaacattagcgaacatcagctaagtaagggctgccaaagatgtgccagtgtttgccgctggcgcccctctccgcccaggtgccaagtgcgcgtgcgattcaaacatcagttatactagagacagctttacttgatatcaaacgagtggaaggggttttgaatagaatgaacattgcaaccattggaacaggtgtgattgtggaaagcttcttgcaagcgattgaccagcttgacggcgcttcttgtcatgccgtctattcaagaaaggaagcaacggcaaagaagctcgcagaccaatttggtgtaaaaacgacttatacagatttaacggctatgctagaagatccaaatattgaagccgtttatattgcttcaccgaatcgattacatagcgagcatgccacggctgcattaagaaacggaaaacatgtgatttgcgaaaagcctttcacctctaatgtcaaagagctggaagccttaatcgcactcgcaaaggaaaagcagcttctcctatttgaagccattacgaccgttcatatgccaaactatcatttaatcaaaaaacaccttcatcatttaggtaaaatcaaactggttcaatgcaactatagtcaatattcaagcaaatataatcagctgctagcgggcgaaacgccaaatgtctttaaccctgaattctcaggaggagcattgatggacattaatatctataatgtccatttcatcatgaatctcttcggatcaccggagcaggtccgctaccaggcaaaccgtcacccaaatggcatcgatacatctggtgttttaactttcacctacaatgatttcattgcgacaagtgccggcagtaaggatacaagcagcatgaattttgcattgattcaaggagaaaagggcttcattcatgtgaaaaatggggcgaatggctgcgaggaagtgctgcttcatgtgaaagaccaggtgatctcactcaatgcacaaacaaattcaaaccgcctgttttatgaagcagaggcttttcagcacatcattgaaacaaataatcatgaacagtgctatgcatggcttgatgaaagtctctccgtcatgaaagtccttgatgccgcaagaaaagatgcaggtattgttttcccagcagatcaattttaatgaaaaaaccgccttctatgagagggcggtttttgatgattaaatactctttgaataggcaacaaggcgctgagacatgtggttcacttcatcgactgaagcatttacttgctctgttaaagcagcctgtgtttgtgtaagagctgtcatgttcgaaatgttttcaagaatttcatcaatttgtgttttcatttccgttaaactagattcgatattctccgttgcattggcactatgaagcgccagtttacgcacttcatcagcaacgactgagaatcctcttccttgttcaccagctctcgctgcctcaatcgcagcatttagaccaagcaagttcgtttggttcgctacttctttgatcaagtcagaaatatttttcgtctcatctgcactattttttgctaaattggcagcagatgttgactgctcctgtgcgacagcaagctcttgcgcttggtttgtcacagagctgatgcctgataccatctcgctgattgaacttgatagctgttctacttgtgaagccatttcattcgctgttttctctttgtttttttctaacgtgatgtcacgaatggttccagccacacgaagaggaacacctttttcatcacgaatggtttcaccaccggcatgataccagcgatactcgccatttttgctctgcaatctgtaatcaatatcaaatggtgtgcgtccagagtgatcatttaaatgatctgcaaaagcttggagagctttttcttgatcctcaggatgcagacggtcgctccagctgcttaatacgttcgggaaatccttttcgtccgtaaaaccaagcgtttttctgaattgcggggaccaccagaactcgttattcgggttgactggatcgccggcctctacgaccatgtcccaaggagcctccacaagcgcacggttgattaagtcatatctcgtcacgaatgcttgcagttcttcttctttcaatttctgatcatgaatatcaaaaagagctcccgccacacgaagagggacaccatttcgatcacgaatggtcgtgccagttgctttgaaccagcgataatctccgttcttcaacttcaagcgatattcgatatcatatggtgtacgtcccgaatgatccgataaatgcgaagagaatgcatttagggtatattcttgttcatccggatgaattcgagatgcccagctgtctaaaacgttcggaaaatcgtgctcgttttgaaagccgatcattttgcggaaatcatccgtccatgtgaattcattttttggattgactggatctccagcgatcacgaccatatcccataaaccaacttgaatggcttttgtcactaaattcatccgcatttgaatatcttcatttacttcctgcatcttttgcaaagcttcatttatttgggctactgcttcaatcgtttgacttgaagagaatgcagcagtatctattcttgctgaaaggtctcccttctcaattcgttctactaatcgactgctctcatttaaaagggttcccgacgatgaatcatttgcttttctcataaacatctttcataactcctttcattccttcatacttttttgaaatattttacagttataaacaattctttattaggactttagtaatacaaaagatatatcgacaaaaactgaaaattgtttatgtcagaatgaaggcaaatgttcattttttcacgaagtttcagattttggggatgggtcatgaatgaatctatggaaaaaaacggctcatttgatagaatcaaccgccttttttgtctgaaaaatctctttttttatattgacactgacgtcccgaaaaaagaaaatggaacataagcatttttaaaaaaggagaacgttatgagcgcgaatcaggaacaacaagaattaaaaaagcttttatcaccgcgtcacattcgcatgattgcattgggcggggtcattggtacaggaatctttaaaggaagtgccgatacaatcggtttagcaggtcctggggtcatcttttcctatgtttttgctggattattattgctcatcgtaatggcagccttagctgaaatggcgattgtctatccgggaaataaccttcgcgacctgatacagattgcgcttggtcaacgtttttcatttgttgtcggctgggtttactgtttcatgtggctcactgtgtgtgttatcgagattattgcggcaggcagcctgcttcaatactggttaccgaacgtgccgctatggtcactatgtttactctgctcactcttagtcatcggaattaacttaaataatgtaaaatactttggtgaaattgagttttggttcgctggaatgaagattttcgttattattgtgtttattattcttggtgcagctctattatttgggatcattccgaacgaacaaagcacatcggcactcaccaactatcaaaacttcgtcccgaacggatggggtgcgatctttgcatctttactagttgttattttctcttatgggggctctgaattgatcgggctgaccattacagaaacaaaggatgccgaaaaggtcttacctggtgttgttaaaagtatgatgtggcgtattatcttattttacactttgccgattttgatcatctgcggactcattccttggaatcaaattgatccaaataacagtccatttgttcaagttttttcagcagccggtatgcaaggcgcctctcacttcattaattttgtattgattacagcggttctatcggcggccaattctggcatttatggaacaacgagaatgatgcattctctctctaaatcagatggcggtccgaaaaaactggcacaggtcaacaaaagaggcgtccccattttgagtttatgggtgaccgttctgtttcttctcatcggaacattctttgcttacttatatccagagcaaattttcagttatatgctggctattcctggttttgctgtttcacttatttggattagcatttgcatggcacatctgaaacttcgcccgaaatatccacaggagccgtatttcaaagtgtggctgtttccgtatttgacattatttgcaggtcttgtgttaagtgtgagttttgtgatgtttctattcagacaagaaaacttgcctagctcgattatcagcatcggtttcttaatcgcagccatcatcgcttcattcttaatgaaaaagaaggcttaaacactaaaacccgccattgaggcgggttttttcataaactgctgtcttctgtcacttcaaaatcaacagacgctttcggtatgccgttgatgatgattgttaatgtatgagtcccctcataatgttttctcgtcgtcatattttgaaaagactgtgacctgacgaattctctctgtaacgttgcgtctgtttcaaactctgtgattttaaataccttctgattgcgggtcccccgagccttgacgtagtctatggcatactctacacgcagctttagcggcttatcagcttgtagggtaaaatgaaatgtcattttctctccgattcgaataggatcttgtacaatcttcaaatccgttacttgaacggatggatcgtccccatagccaaacaacgccataatagctggatctccttttttgagtaaggtacgagatgcatgtttgacaatccagttagtatgtttgttggatccataccagctttgaaccgtctgcttcatcaaatctggctgaattgcagagatatcatttaaatgattcgctacacttttttgcacataccgagatgggtcagccttcaagttttccaaaatgggcagcgtgaccgaaggattctttttaagtgaagggacagataagccccacggcagacgcggtctgcagccttcactagccagcctccgcaaatgctcatcttgatcctgagaccatacgagcatttgcgccagcattttgtcctgatcttgaatcagaaatggccgaacggcaaattcagaagtggaaaagggtgtgaagaattcgagcgccttgatcgagaggtcccagtttgcaaggccgtacgtctcgacgtagtctggaaatacgagcgcactaagccctgaaaaatgcggggctgcctgacgcagtacctcaattgtcttctcatagttttgaggcagacaggcatgcatcgattcagtgactcgtcgcatccgcccttttaattcaagctgctgccaatcctcttgaaatacgagccgcttgaatggctcagcatcaaatccagacgaagcctgcgcaagtttctccgctaattcttggataaataattcattgtacacatgttttaatggttcgatcgtgtccgcctcccacatctcaatatcattattttaccccaatctgaagaaagtggtatcacaacacacaaaaacagcccgactcatatgaatcagactgcttgttcgctatataaacatattaataatcataataaatgcaatggcactaacggaaatgatcgtctccatagccgtccatgtcaaaaacgtctctttaatggtcataccaaaatactccttgatcagccaaaaaccagaatcattgacgtgagataaaattaacgaacccgctcctgttgctaacacaagcagctccctgctcacatccggcatagttgcagcaattggtgctacaatacctgctgccgtcatcatggataccgtcgcagatcctgttgccacacgaatcactgcagcaatcagccagctaagcaaaatcggtgaaatcggcgagtgtttggctaaatctgcaatataatcaccaacacccgaatcaatgagcacattgttgaaagctccgcctgctccaataacaagcaaaatggaagcgatcgggcctaagcactcattactaaaggaaagcacccggtcacggctcattccttgcataaagccaagactgaagaaagaataaaccgttgcaatcagcaatgctgttatcggatctccgatgtacttgaatacctgaaaccacatattgtcctctggtaagatgatgtccgccaatgtggcaagaagcatcagaatcaccggcaccaatatggtaaacatcgtattcacaaagccggggagtcttcgatcttcattgcgttcagtgaattgctttctcagcatctccggaacgggtttatgtatacgttttccaatccacttaccatacagcggtccagcaataatcgctgtcggcaatcccacaataatagagaagaaaatggttttccccacgttggcatgatagatgccaacggctgccattgccgctggatgaggcgggactagcccatgcacgacagacaggccagcgattaacgagatcccaatggtcacgagcgagatgcctgtttcaatggcaattgtaaaaagtaaaggaatgagaagaacgaaaccgacctgaaaaaagacaggtatccccacgataaaagcaacaaacatcattgcccaatgcacatttttcgtcccaaaccgcccgattagagtttgcgctattcgctctgctccccctgattcagccatcattttcccaagcatggtaccaagcgctagaacaatagccagcaatgataacgtattgcctaatcccgttttaatcgattgaatgatttcctgcaaatccatccccgtcgcaaagcctactagcatcgaagtaataattaagctcacaaacggattcaacttagcgactgtaatgagaatgagtaaaaggacaatcgccgcaatcacaatgaataaaagcatgttctcccaccttttccctgatgtttaacgattttgttttaattgcagcgcactaatgacatcaaattcatctttcagtttgtcgtagaggcgctcatataaataaaacagctctatgtaagtttcattgttcttcatattaggttcatgacgagcagagattcgaatccactcttgaacttcttctatctcttccatatgacctaaactatgaagtgcaaggacagcagcccccagtgctgacgcctcgtagctttctggaacaagcacttctctacccatcgtatccgctaaaatttgccgccacagcggagatcgtgcaaatccgcccgaagctctgacatcctttgccgaaccggttaaatctcttaaggcaacaccgatcgagaaaacactcataatgacgccttccaacacagctctaataaaatgctcccgcttatgctgaagaccaattccaaagaaggtgcctctcgcatttggattccaataaggtgcacgctcacctgataaaaatggcagaaacagcaaaccctcagaaccagctggaaccttttccgcgatatccatcatcagatcgtaagggtccacacctagacgctttgctacctcaacctctgacgacccgaattcatccttcagccatctcagcatgatcccgccattattggtcggtcctcctacaacccaatgcttatctgtcagggcatagcagaacgttcttgattgctcatctgtaattggtttgtccacaaccgtacggaccgcaccgcttgtcccaatcgtcacagctacctctccttgaccaatcgcgcccacacctaaattcgctagaacgccatcattcgcaccaatgacaaatggtgtatcttctttaatgcccatgcgcagtgcaatttctggctgaagtcctctcagttgatatgtcgttgggacaagttcggatagttgactggcttcaattccagcaatacgaagcgccttctcatcccattgaagcgattccaaatgaaacatgcccgttgctgaagcgattgaataatcgacgacatactgaccgaagaaatgataaagaatatattctttgatcgaaataaattttgctgccttcttaaagacattcggtgccatttctttcatccaacgtatttttgaaagcggtgacattggatggatcggagtacctgtccttttataaatgtggaagccattcatatctgatttaattcgtttcgcttgttctgcacttctgttatctgcccaaatgatactgttcgttagcgtctttccatcctgatccatcacaattaaggaatgcatcgctgtactgatcccgatgcctataagattttcttcatcaaatgctgcttccgtcaatgcacctcttacactcgcaatgacggcttctaatatcttctcagggtcctgctcaacccatgctggctggggctgaatgagctcataaggaactgaatgcttcgataataccttcccctgaggtccaaacagaaccgcctttgtacttgttgttcctatatccaaaccaattaccgcctggttccccttcatctgtatcacgcccaatcattgatttgaagtcacatatgtagtttttgaatgcctgctaaatcccattataaaaataattttttcgacattcaacgaccgaaaagaaaattattttcaataaaaagctcacaatcgttaccacatcagcatttttcattatcagaaaaatttatttttggaatcattacacccttttttgtgaaatggtttctcgcatttgttttaaattcgttattgtttcctgctgccttaaatgagcaagtgcaaaatatagcacgtcaatgaccgtcagctgagcaagtcttgcggacattgcttctgttcgaaaagccgtttcttgcgttgctgtatacaacgtgacatctgcaagctggctcaatggagagcgctgatagcttgtaatgccaatggttttggctcctttttcctttgccgttttcatcgcatcgagcaaatctttattacgtccagaatgagaaataccgatcactgtactgtgctggtcaagaagaccagcagacatcgcttgaaagtgagaatctgtgtgaacaatacagttgatgcctgtcctcataaatttatgaaaagcgtcagtcgcaatgaggccagacccaccactcccataaaactctaagcgttttgcttcatgaatgatttgtatggccttttctacatcccctggattcaataattgaaagctatcctttaatgcagatatattcgtctgaaaaaccttttgcataaaaacagccatatcatcatcaagactcatttcttcatctacataattaggctttgtttggtctatttcctgggcaatagcaatcttcaaatcttgaaagccctcaaatccaagccttttacaaagacgaaaaatcgttgcctctgagcttgcggtctttttcgcaagttccacaatagacaaatggatgatgtcgcggggctcactcgtaatatgctctgcaattgctttcagctttggcggcaaccctctgcttgctgctcgtattttttcaatactacttaaactaacagaagccaattgacttcactcctcccttactcatgtgaacgcatacatttcctcatgttcccatcttataaaaaagaagcctgtttgcacagacttcttttttaagcgctcattgttttgatcaataaatcaaagaaagcgtcagcatctacatccgtacacacttgaacgtttcgctctttctcccattgatgctgaaaatcacagatcatctgtccatcacaaagctcactcttcgtctcgacatccacatgaaaggcctgtgtgctcacgagctgcttgtcaatggcaagactgacagcaagcggatcatgcatggcacacgcccacacaccattccgctcaaaatagcgctgacggtaaatgcttgtgctctctctaatataatgggctaatgtttcattctgaatggcatcgattctttcatccgtaagcaagacctgtctcgtgacatctaaacccacttgagtcaataaagggaatcctgcattcagcactaacttcgccgcttctgggtctgcatatgtattaaattccgcaaccggcgtgacattcccctgtccttcaacgacaccacccataaaaatgacttctttcacgtgatgaatcagctcaggacactttttcactgcaagagctaaattcgttaaaggtcctgtcaacacaagcgtaacctgcttcgagtactgcatcacccggtcgatgataaaatcaggcgcaaaaccagcatctgcttttttcataggctgagcatcctttaaagcaccgccaatcccatcctctccgtgtacccgatgttcataatggggcgctcttaaaagaggggttgctgcacctttgatgacaggaatatcatctgcctcaaccagctcaagcactttacacgtattcaatgtagccgcatcgacagacacattcccacacaccgttgtaatccccaacatatcaaaccgattacttttcactgccagcaatatcccgatggcatcatctattccagtgtctacgtccaagatcaatttctttttatttgccatggttgaaatctctcctttatttgaaagtgttgttaggggaatgatagcatattatttttgaaattgatttagggaatcaatcggctttgtcgacttgttatttctctttttctccaatgtctttcagatattgttcgcgttcttttttagaaagactatttagaaaatcttcttttacttgaggttcaaagtcatcccagttctcaaagcggtctgataaatcgggggaatgactcatcgaaccgatttcttttgttctatactttaatgaagcggagaactcgtacttttctggctcaccatttatatatcctctaattacgatgtagcccattggattaatagtcaccctcttcttaaacgttatggtcttaataaattgatggatgtcttctttgcgtaaaaattcttctattttaggcttcattttttctgcgagctcttctgctttttcttgatcgctcttttcttttaccacatcatttgatttactttgcttattgtgctgagtgattaacgaggtcactgagacaatgatgataacgaccaaaacagatacaagttttattgtgtttttcatgtctaccgttgcctccttcttaataatgaaaaataaaaaacaggtaggtgattacctgttttattatttttctccaatatccttaagatactgttctcgttccttttcagagagtcgtttaagttagttttcctttaattctggttcatccttaaatttatcccaatctttaaaaagatatgtcaactcaggatcataacccattgaacctatttttttagctctatattgtaaagaagctgaaaatccatacttctccggttcattatttatatagccatcgattataatatcccccataggattgatggtcacgtctttttcaaacgttatggttttaataaagtgatgaatgtctcttttatgtaaatgccttctatcttaggcttcatcttctctgcaagttcttctgctttttcttcatcactcttctcttccactacatcatccgacagactctgattaatgtactctacaacaagggcagtaactgagatgatgacaaccacaattaatacagaaaatttcattgtatttctcataaaaaataaaaactcctttatgaacctttaatcaatctaccaatgaaattgacacaaataaaaacaggtaggtgagtacctgctttactctttttctccaatgtcctttagatattgctcccgttctttttcagagagtctattaaggtagttttcttttatctcaggctcatctttatatttattccagtctttaaaacgatatgacaactctggggaaaagctcatagaaccaatttcgttagatttatgcattaaggatgctgagaaataaaatttttcaggatcatcatttatataaccatcaactgttacatatcccattggactaatggataccttttttttgaatgttattttttctataaaatgatggatatcttttttatgtaatctttcttctatttttggtttcattttctctgcgaactcttctgctttttcttgatcacttttctctttcacaacagtttcccctcctgaatcattcgatttttctttcttatcttgttggataataagagaaactattagaataataacgatagtaaataatataatcacaactttgattgtgtttttcattagataaatccacctttgttaatctagaggattttaatcctctttttatagatatctatcatacaatatcatataatatataagataaatattacagtagtgacaattttgtctaaaactgtagcccaaaacgaactttctgctaaagactataatcttatttccaatgcagcttataaaatagattactatagaatttctagtgaaatagacattagtaaaaataagaccatgtatgtcattgattataaagaaacaactaaaggtcttaatgcactaactatcgtttccgaagaagattttgatcgctccgatggaggcaaagacctcaccaaaatcaaaaacgcagtcatcgcctaccgcgggtcagaaccgattggcgctggccaatataaagataccattaaaaaacatggaaaaaaagagtcagatgatcttctttctaccattttgacgaagctgcctccttttcgtcagtcacagacgtcaaaggaagtcacgacgaaggtggcgacagggacaacgacctatacaaatgagattgtgcaagattggctgatatcagatacaaagtatttgattaaaaatattccctttgaacatggtgcagagaatcaaatggttcaagcagatcggtatgcgaaagaaatacataagaaaatgccaaatgccaagatgtatgtgacagggcattcacttggcgggtcgaatgcgtcttatgttcttgttaaaaatgattttattaaaggcggggtcacctttgagaatccgaatatttaccccaatctatcggatggccttcaagccaaagcattaaaaggtgattaccgcagtagattaacagaatatatcaatctcaatgacgggctttctcttttaaatcgacatacgacagaaatcggtcgtgtgaaagtgatgtatgatgccgctttacctgaaggcgtcgattactccgaggactcctccaaagccgtccaatttatgaaaaatctcctcaatcgggcaatgagcgttaatccttcattggatgcaaatttgtttcttgaagcccttgctggcagccatggcttagatcggtatgccttttcatcagatggctccgttgaaaccattgatgacatgttgagaaaaaacccttctctcactgccgccatgttacatcaattgagtcagtcgaatgttcatccgcaaagtgtggtggcaattttaatcaagtcccatgttctcatgaacacaggtcgtaaattctcgacatatgccgagcaccatatgcagcaaattatccgcaaaatcgagaaactcgatgacaaagtggatcaatctgtggaacaggtacgctcgagatacaaacagattgttggctttggttcctatgatcagctgacggcttctgatgtggatgccgtgattcgtcatttaaaaacggagggacttgagaatgagttctattccgtcaaagagtatgatacagcgattgatagcgcgatgaatataaaaaggtggctggactcaatatcagatgatatgagccagctagggaaagaataccatgatgcagatacagccctagcaaagaatatgggcatttcataaggagaacgaggaatggaattttcaaagaaacaaccaacagatgcagaccgttttttgcaacgaatgacagatacgcatacatcaagctccatcttttctcaaacaaactttcgcactgaagacatgacaccagcagagctggctgctttgaaagcaaagatcaaagaagagcagaaaacagcgctaagcagagccatccggcatcagctgcaacatgaatttgcagaagaccgccaagaagcggggaaaattttagatctaattgatgaacttcagatcaaagtgtataaacatcaaaagcgcatccattcgcatatgtcaggacaagccattgacgctttaacagagaaaatcgagcaaagactcaagttttacgagctgaaagaagatgttcaatccgccatcgactcgattggcatttagatgaaccttccgttcgatgaatcttttccccgtctcactcgtatatactaaaagagtgattgatttgaaaggagatctgtttgtgggatatattttgttattttcggttgtgatcggtcttgtcttgaccctcttgctcacaccgctcagattaatcgttagaaagaaagggacagaacagcaggttccgcttatgtggattgcaggccttgctttactgtttatggtcggaatttttgtattctattacatcaccaatttggatcgcaatccttcatccctctggttgattggacttgttgtgacagcagcaggcgcctttttatcagttggattggagcgtaagatcaaaggcgtgctgtttcttattctcttactgctcggcatttatatggcgacagcttttctattcaatgcgaatgagaaatttgatgtctccaaaatggatcaaaaggtggaaatcaaagcgtttgatgagacggaaacacctgcgagtgtcccgcctcaatttgctcggaacaaaatgaagaaatccttcggacaggttccgaacacaagctactatgagcttggcagtctgcaaatccagaaggtcaacggtgagtatgtatacatcgcaccagtggaattctcggatttctttaaatggattcgttcagggagtacgccgggttactttacattaagtgcgaccgactcatctgccaatccaaagtttgtgaaaacagagatggtctacacaccttcctcttatttcaacaaagaaattgagcggcatatccgccttcaataccctgatttgattttctacggcgacacacagctggaaatcaatgatgatggaaagccttattacattcgtacgtatggcgattttatctctgcccgaaacggctttaaagcttccggcgtggtcgttgttgatgccaaaacaggtgcaacgaagaaatattcgctagatcaagtacctgcttttattgatggcgctgtttcaccagaggccgttagtctgcaaaacagctatttcggaaactatattcacgggttctggaacagcatgtttggaaaatcagatgtgaagctgccttcagatgaaggaacagaagccaatgtgagtccagtatttgattcaaaaggagatatgtactacttcacagatttcacaagtccgaaagagggcgttgattcgatgcttggatatgccctgacaaatgcccgaacaggaaaagcgacttattataccggtaatcttgaagcgtcctatatggattctcaaggcgctctgcaaattatcgagaaacgtttcatcgagaagaaatggaaaggccgcatgccgattctgtataatttctatggagaagccagttggctcacgccggttctcgattcaaatggattcctgcaaaactactttatcgtgtcggcagccaatccagaaatcgctgcgtacgcttctacaccaaacgaagcactgagagcctataagacagctctgcaaaaaggcggcggtaccgttaacagttcctctaagcaggaaaagaaagaaactacagggaaagtcaaacgagtgtataaagaaaagaccggtgattatacaaccgtcaccttcctgctagacgatggaaaaagctacaccatgtcatctgaaaaagaacctctcgtcatttatttaaaagaaggcgatcaggtcgccatgaaatacacagatacaggtgaaatcttccttccagttgatgaaatcaccattaaagggttataaaaaagatgcttctcctaccgaggagaagcatcttttctctctttccttaacaattcaacaagcaattccttatttttatttccccctgtcataggtgactcgacataggagaattttcgtttgaaatccattcctctcacagaaatgacagccagttcccccccaatgctgcctcgctggaggacatatttagataaaatagaaagccccattccatgaatcacagcctctttaatcgcttgattgctgctaaatgttacaaatgtccgggctttcagtccatttgatttcaggacgtgctgtaagtattctccggtacctgacccctcttctctcgtgatccatgtttcgttttgcaattgatcaatcgtgacatcctttttcttagcaaaggggtgatctaatggtgcgacgatataaagctcgtcttctagaaaagtttctactgtcaattctttgtcattcgtctgtccttcaatcaaaccgatgtcgacatggaataagcggacatgactggcaatcgcctctgtgttatcaatgaccacctcaatgtccacatgcggatagagctgatgaaactctgccaatatttgcggcagcacatactctccaatggtaaaactcgccccgattgtcagcttccctcttgccagatgatgatgttcataaatatcctgcttcgcctgttcatataaacgaatgatttgttttgatcgatggtacagcatatccccagttggtgtaacagttagttgctttggcgaacgattgagcagaacggtctggaattcctgctccaagttcttaatatgaagactgacactcggctgagaaatccgcagcttttgggctgcctttgtaaagtttttctcttccacaactgtcacaaatgtcttcagtgcatcgtaatacatcggtccctctcctatcagaaatcttaatccaaaacctttcttatatatatcttactaattccttcccagtgcgtaaagaagcgctttactgaaaacaatttaataaaaatatttactaatttttttaaagactctatactagaaggagatattttctataggaggtgctgatttggcagctaaaataaaggacattgctgaaaaagccggattatccattgcgactgtatctcgcgtactgaaccaagatcccaacctatctgtcacggatcaaacacgcgagaaagtatacgccgccgctgaagctttgtcctatcaaaagaagacattcaaacattcattaaaaaaaatcgcctttctctattggatgacagaaaaggaagagcttgaagatatttattttaaatccatccgtctgggcattgaggaacttacgaatactcgtagtttaaatgtcaccgcttacaaaccatctgacgggcttcactccattgatccttctacagaagggatcattgccatcggccgatttaaaaagtcagagcttgaccaattatatgcgatcacccagcatatcgtttttattgatacgtcaccagatgaagaccgttttgattctgtaaagccaaacctgaaacgcattgttgaaaagatcatcgattcttttattgaaaaagaacatacatccattggatttgttggcggcacagaccttgatctgaatacgaatatgcatattccagatattcgtgaaacgactttccgtgaatatatgatggctcacaatgtccttgatgagcgattggtctatgtcggtcaccatttctcagtggatgaaggttatgcgctgatgatgaaggcgattgatgagcttggagatgacttgccatccgcattttgtgtcgctagtgatcctcttgccatcggctgcttacaagcattaaacgagcgcggattttctctgccgaaccgcgtgagcgtctttagtatcaacgatattcatgtgtctcaatatgtatcaccaccgctcaccacgtatcatatccacacatctttgctttgtgaaacagcagtcgatttactgttagaaagacttgtagacggcagaacattaccgaaaactgtgctgattgcctcagagcctgtctttcgaaaaagtacaatctaaacaactggaagccccgtccaatctggagggcttcttttctctctatatgagtaaaaaattttacttaataaatttaataaaacatgtttactttttttacttaagttgatattctcacattaagaaagcgttttcttattatctatgaaaaaagaacgagaggggattacgaatgaaaaagggaaaatgggcgacattatcagcagtcgttgggactgctgtgcttctgctttcagcttgcggaccgggagatgacaattcaagcggaacacagccagcatctacaggtacaaagaccttgctagtgtgggaggatgtcaaaaaatctgatgggattcaagacgctgtaaaagaattcgaaaaacaacatgatgtgaaaatcaaagtggtcgaaaaagcttatgccgaccaaattgaagctctccgcctagatggagcagctgggacaggtccagatgtcatcacgatgcctcacgatcaaattggatcagctgttactgaagggctattacaggaaatgaagccagatcaaaaagtgatgaactccttcacagacgaatccattcaatcacaaacggtaaacggcaagctgtatggtcttcctaaatccgttgaaacgacagtgcttttctataataaagatcttgtcaaaaaggcaccaacgacacttgatggctggtatgatctttcgaaaaagctgacaaaagacggaaagtacggttttgttgcgaaatgggatgaaatttactacgcacaaagtgttttaggcggatctgggggttatattttcaagcagaaaagcgatggctcttatgatgtcaatgacattggtctgaacaatgatggcgccatccaaggcggagaatacattcaaaaattctttagcgaaggacttttcccgaaaggcatcattggtgaacaaggaatcaacgtcctcaactccttattcacagagaaaaaagcggctgctgtcatttctggtccatggtcatttggtccatttaaagaggcgggtattgactatggcgtggccgagctgccaacactccctaacggaaaacatatgagctcattcttaggtgtgaagagctacaacgtctcctcttattctaaaaataaagaactagctgagaaatttgttgaatttatcacgaatgaaaaaaattcgaagaagcgctttgaattgacagaggaaattccaccagtgaaaaaactgatgaaagatccaatcattacggaaaacgcgaatgcggatgctgtttcaaaacaaacgaaatacgccacactgacaccgaacaatcctgaaatggcagaggtgtggaagccgattgacagtgcattaggtctcattgcaactggtcgtacagatgtgaaaaaggcatttgatgatgcggtcaatcaaatcgactctcaaattaaagcaaatcactccaaataacatcaaatgcgggtagtcggtagtctatcaaactgcccgtagttgatctaatttcatatgaagtaggtgttagacgtgacgggtaaccttgaactagaccgcacacacacagtggaatcaaagacacaccggagacgggcgctaatgttctcctttatacccgggatggggcagatatacaacaaacagtacggcaaaggggcactctttttcctgttcggcgtcgcttttttgattgtattttatgatttattcaatattggcttctggggactgttcacactggggacgatgctgcctcgtgacaactctgtttttcttttagcaaaggggattattgcgctgttaacagctggttttggtatcggcttttatgtactcatgatgcgtgatgcttttatgaatggaaagaaacgggatcaaggggtaccacttcattccatccgtgctcaatatcatcagctcatcgatcaaggctttccttacttaatgagcactcctgctttctttttacttctattttctgttgtctttcctattatgttcagctttgcgcttgcctttacgaactatgatttataccactcacctcctgccaatctgatcgactgggtaggaatcaagaactttcaaaatatcttttccattgatatttggagagacaccttcattgatgtacttggctggaccgtcgtatggactttggctgcatcgacccttcaatgtgccctcggcatctttttagcggttctgctcaatcagaaggatttaaagggaaaacggtttttcagaaccattttgattcttccttgggctgttccaggctttgtgaccattttggtgtttgctggactgttcaatgatacattcggggccattaacaatacactttttgcatcgatagggattgatccaaaaccatggctgacagatccattttggagcaaaatcgccctcattgcgatgcagacttggcttggatttcctttcgttttcattatgacaacaggcgttttgcaggcaattcccgaggatttatatgaggctgcgaccattgatggagccaatttttttcagaaattccggtccatcacgttaccgcttgttctctattccattgcccccatcctcatcacacaatatacgtttaactttaacaactttaatatcatctacttatttaatggcggaggaccgcctgttgcggggtcaaccgctggaggaacggacatcttggtatcttggatttataaactcacaatgcggtcctctcaatatgcactcgctgcggctgtcacgattttactttcaatctttgtcatcgccattgcactctggcagtttaagagaacgaattcattcaaagaggaggacatgatgtgatatgggatcaaaacaaaacaagctcattcgcctgagcattacttattttatccttttcattgcctccatttgtattctatatccactgctttggacaataggtgcttcctttaatcctggaaacagccttatgagcacaagtatgtttccgaagaatccaacgttcagtcactttaccgagctcttctttggccaaggcgcactttatgcaaaatggtattggaactccatgaagatcagtattgccacaatgttgttaacgttgattcttgttagttttacaggctatgccttttctagattccgtttcaaaggacggaaaaatgggctgatgctctttttgctgctgcaaatgattcctcaattttcagcactgattgcgattttcgttttggctcaaatgcttggactgattaacagccatcttgcactgattttgatttatgcaggcggacaaattccgatgaatacgtatttaatgaaaggctatcttgatgcgattccgaaagatcttgatgaatcagccagaatggacggcgcagggcatttccgaattttcatccaaattattatgccgcttgctaaacccattttggcggttgtcgccatcaactcatttacaggaccactgggtgatttcatcatctccagtgtcattgtccgctcacccgaaatgtatacactcccaattggtctgtacaatctagtgtcagacaaaatgggggccagctacacgacctttgcagccggggctttactcattgcgattccagtcgctttattgttccttgtgttacaaaaacaatttgtgtccggcctcacacaaggcggcacaaaaggataaggggagatttgatgaagaaatggatgcttgtcacggttatcgttttctttttgatggggttagggattttacctgaagcaaaagcggatgccatttccgttcagccgatcaatggactgcaaggtgatttcattaaaggagccgatatctccatgcttgcggaagtagagagaagcgggggcagatacttcgaccagaacggaacacaggtggacccgctcaagctattaaaggaaaaaggcgtcaactatgtgcgcattagactatggaaccacccatacgacaaccaaggccatgcctataatggcgggacaaatgatctcaatacagccatcgctttatcgaaacgcgcaaaagcgcaaaatatgaaagtgctgcttgattttcattacagtgatttctggaccgatcctggtaaacagttcaaaccgaaagcatgggcatctctttcacaaaacgatttggtaaaagcggttggcacttacacaggggatgtactcaaaacgatgagagcccaaaatgcactgccgaacatggtacaggttggaaacgaattgaactcaggtatgctctggccgaacggcaaaagctggggtgaaggcgggggtgaatttgaccggcttgctgctttgctaaaagcgggaacaaatgcggttcgctctgtcgattcaaacatgaaagtcatgcttcaccttgcccatggcggggacaacggggcctcccgctggtggtttgatgaaatcaccaaaagaggcgtctcattcgatacgatcggtttatcttactacccgtattgggacgggggatttagcggtcttactaacaatatgaatgacattagcgcccgctatcacaaagacgtcatcgtggtagaaaccgcctatggcttcacaacagcaaatggcgacaacctagaaaactcatttaaccaagattcagtcaatactgctggctacccagcttcacctcaaggccaggcatcttttatacgagatctatcagaaaaaatttcacaagtgaaaaacaatcgcgggaaagggttcttttattgggagccgctttggattccagcgaaaggtgccccgtggtcaagtcaatatgggctggcttatatccaaacaaccggtacagtcggaaatgcttgggaaaatcaagcgatgtttgatttcaacggaaaagcactgccttctctagacgtatttaaacaaatgacaccgtaattaaaaggataggacgtgacaaaatgggaaagcgttacccactcgttcacccgaatgtgaaaggctttttgcatggtggcgattataatccagatcaatggcttcatatgccagaaatcattgacgaagattttcgattaatgaagcttgcacattgtcaaacattctccatcaacattttcgcatggagtaagctagagccaaaagaaggtcagtatgattttgcatggctggatgacatcatggaccgcttggcagcgcagggggcacacgccattcttgcaacaccaagcggggcaaggcctgcttggctgtcacaagcatatcctgaggtattgcgcgtcgaagcgaaccgtcagcgtaatttacatggactgcgccataatcattgcttcacctcaccagtttatcgagaaaaaacgaatacactcaatcgtttgctcgctgaacgctacaaggatcacccagcactgatcatgtggcacatttcgaatgagtacggcggcgaatgtcattgtgatctctgtcaggaagcatttcgaggctatttgaaagacaagtacaatcataaccttgaagctttaaaccaagcatggtggacggggttttggagccacacgtatagtgattggtcacaaatcgaatcacctgcaccgcacggggagcacatgattcacggaatgaacctagactggaaacgctttgtcacagcgcaaacgatcaatttttatcaaaatgaaattgaaccgctgcgggaattgacgcctcacatcccagtgaccaccaactttatgggcgactacccgcatatgcgcccatttctcggactggattatcatgaatttgcaaaagaggtcgacgtaatttcatgggatagttatccagcatggcatagcggcaaagaaacaaccgctgaattagcgtcaaacgtagccttcgttcacgacttatatcgttcattaaaggacggtcagccatttctcgtgatggagagtacacctagccttgtgaactggcatgaagtgaataaggtcaaacacaaaggcatggcacacctttctgccatacaggcgattgcccacggatcagactctgtgctttacttccagtggcgccaaggacgaggtgcctccgagaaattccatggcgccgtagtcgatcattctggacatgaacatacgcgcgtgtttcaagaagtcgttgatctagggaaacagctggagcagctgcagcccatcgcagggacatccgttcaaccagaagtcgccatcatatacgattgggaaaaccactgggccattgatgatgcgcaaggcttaaataataccaacaaacgctatgtagaggcttgtcaaactcattatcgaagcttttggaaaaaaggcattcctgttgacattgtcggcatggaaaaggatttctcatcctatcgtgtgctcattggtccaatgctctacatgatcaaaccaggcgttgcagaaaaaattgaagcctttgttaaagcgggcggcatttttatcgcaacctattggagcggtatggtcgacgaaaatgacctctgtttcctcggcggtttcccgggtcctctccgccatgtacttggcatttgggcggaagaaatcaacacattgatgccagatgaacacgtattaatgaccacaggaaatggacgcacctaccatgtcgggcaatattgcgaatccatccatcctgaaacggcctctgtgttaggacattttgagaatggctgctacgaaggacagccagccctgactgtccatccttttggagatggaaaggcatactatatggcttccgaaaatgagcagattttttatgatgatttttacgaggatctcatcgcaggaatggagatacagcccgtcctatcagcggtgattccagagggagtcagtgtccaaaaacgaacagatgggtcgcaggactatgtgtttatgatgaattttacggaaaaacagcagctcctttcactagattcagaagagagctatcaaaatatgctgacagggcaacatgtgcctcaagagcttcaccttgatccttacgagtacattattatgaaaaaatagattgaaagaggcgtctactcattggacgcttctttcattttggtgaatctaaatacctatataaatttatgtattttaaatataaacttgaacctttatattttatctaaattttttgacatgtttcatcctgcgccaatactggttcgcccatcctttttcaccattttataggtatgaaagcggttgcctaatactcatatttttgataccctttttttcaatgcagatatgggactgcattgtcataaaaagagcaagaaaatgtaaacggtttattgtagggggagggacttatgttaacgtttgttggattgttgattattttaacgattgttgtattgctgatttgggggaaagcaagtccgattgttgccatggtcatggtgcctttaatcggggcattcatcgcaggatttgggattaatgacattcaaacattctttgaagaagggattatcaaagtactgccagtggcgaccatgttcattttcgccattttattttttggcattttacaagatacagggttctttgaacctgtaataaaaacgctgattaaactgactaggggaaatgtagtcacggttgcgatggggacagctctaataggagtcatcgctcatttagacggagcaggagcgactacatttttattaactgtacctgcactgcttccactttataaaaaattacatatgagtccgtacttattgctgcttttgatcgggacgagtgccggcttaacgaatatggtgccgtgggctggccccacaggacgggcagcaagtgtgttgaacatggacccatccgaactttgggtgccgctcatccccattcagctcattggggtcgttctcgtattaggaatggcatttattttaggaaaaagagaagaaaaacgcattcgcgtcaaaatcgccgcaaatgaaatcgctgctgttcaattagaaggcgcagattgggaccgggctattcaatctattagcgagacaggtgatgctgctttaaaacgttatcacttgatttgggtgaatttcattctgtttatagccgtagttgtccttcttgtgctcaacgtgattccggctagttatatgtttatgattggtctttctctcgcactattaattaactatccgaaagtggatgtacaaatggagagaatcaaggcgcatgcacctagtgcactcatgatggccgctgttattttctccgcaggttcgtttctaggcattctcgaaggaacgggaatgctaaaagctattgctgtggacagcattcaaattctacctgctttcctgcttccatttttacatatcattgtcgggatgtttggggtaccactggatatgctgacaagtacagacgcttattattatgcacttctgccaattgtcgaatccatcacatctgaggttggtgtgacgggcacttccgcggcgtatgccatgatgatcggaaacatcataggaacctttgtcagtcctctcgctccagccgtttggcttgcgatcggtcttgcaggagtcgatatggggaaacatattcgctactctttcttctggatgtggggattcagtattgttctactgatcgttgccaaactgataggcattatttaaataaaaaaagacatgcgcacagcgacgcatgtcttttttatttatgaaggatattcatttgtgtgaatgtctgtattcggctttctaataagagacattaatccaatgataaacaatagaaccattggagcgaatgcaagaccgattgttccaattaaaagagtcacagcagacaccaagaaaagaacacctgaaatcacggcacggcggtctgttttcaaaagaatcacagcgacaatcgacagcactgctgcaattccagaaacgaccataaactgcgtaccaaatgcattgactgaagcttgaagcgtttcaatcggtaatgtttcgccttcctcttgtaacacttcattaatttcattataaaatgatggacctaccgagaggattaatgctccaaatccaacaccaatggcattgaggacaatactaataatccccataattttttcacctttacgactaatcatgtgtaaacctcctaaaaatttttaaaatttaactgcctgttttcacttctcgtttttggaaaacaattaaggcaatggctaagaaaatagcccaatagatgactaggacgattagtgagaatcctagagacatgtcttcgataaaagtaggtgtgtctgcaaaatattgtgcaggatcattggcaaacaataagtatttcgcccaatcaaagaagaacatcaaaatgcttgtgatggatgctccaacaatatacgctaacacactgatcgcgatagaaatggcctcacttctaaataccgttgagatggcaaaagaaagtgtccctaatacaacaaacatagcacaatgtgccaaataataagagaccatatttgcaaactgagaccgctcaatgacttcaccattttgataagccaaatgcacatagtcatgatttagtccaaagaatatcgcacctaagataaatgataggataaataacaccgcgataagaaatagagaataaagttgaacagtaaagtatttagataagagaatcttcattcttgatggtggacgaattaacaataatttaattgtaccatgcttatattcagccgagacaatggtggctgcaatgataatcacaaacacaccgaccatctgcagcaaatcagcattgatcttcacataagcccatgcatttttaccgaattgatccgcaggaggcaaatcatgcttgattcgatactcattgatcgctatatccttttcaagagatctcttataaaatcctatattatcctctttcaattcttgtttctttgctttattgatcgattgcagctcagtcttccaatcacctgatgcctgatctccgtcatttgtcttaaccgcaaagatcaacgtggcaatcatccctaaaacaagaagtccaaccataatccaagttccaatacgataactgatcttcatccactcgttttgaatgaggcgaatcatacgtctgcctcctttttacctgttaagcttaagaacttatcttctaaggtttgtttttcaattttgatttcgtacaaatgaatggacgcgccgcttaaatgacgaatcaattccggcattttctcttctgacaaggagaagaataaatactgctcctcttctcttacagtcgtgccttcctcaaatataccaatgagcttctgtgtttcttccagctcaccagatgcgaccttcattcgataattgaccaattcgtcttgattcgtctctgcacgctgatcctcaatcgctatcagcttgcctttttggataatcgcaaaacgatcacacatcaattccatttctgacatgaggtgacttgaaacaatgacagctagcccttcttcctttgcaagccttctcaagtaatctcgtatcatgcgaattccctctggatcaagtccattggtcggctcatctaatatcaacagtttcggtctatgtataagtgcttgcgcaatgcctaaacgctgcttcattcctaatgaaaatgttcggacacgcttatgtttcacgtgctgtaagctgactagttctagcaactcatcaattcgcccttcatccactttcccattcattctggcaaagtgaacaagattttgtctggctgttaaatgattatacatttctgggttttcaataatggcaccaacatcttggatggcatgctgatatgaagattgaatactatgaccattaatcagaatgtcaccagatgtaattggagaaagaccgaccatcatacgaatggttgtcgttttccctgcgccgtttggtcctaagaagccaaaaacttcgcccgcttggacagaaaagctcaagtcttgaacgatctttttcccgtgaatatgcctagatacattatgcagttctaaaacgttcgtcacgttacctctccttctttgtctaagtatcatctatcatctatttccaaataaacaccatgatccgttaaaaatagaagaacacttccatatggtacagcaatgcccaaaagttgtgaaggggatgagccaaaatttagtgaatcatctgtcttttttaaggtagggttaagaaaacaaccattttttatgtgaaaagaggcttgattttttaaaaatgaattattttcaacaggtacatatgtatggaattttgtttaagtttattcctttcacctataaataaagaaaaagaggcttctgactgacagcctcttttctctcattatacctttttcacaaactctgattttaacttcattgcaccaaagctaggaattttacaatcaatgttatgatcgccttccactaaacgaatgcctttgaccttcgttcctatttttaagacggaagaagaaccttttacttttaaatctttaatgacagagaccgtatccccatcacttaatagatttccattcgcatctttgaccacaagctgctcctctgccgcttgttcttgttcaagtgaccattcatgcgcacattcaggacaaaccagcagactgccatcctcataagtatacgttgaactgcatgaagggcaatttggtagattagacatttgtgtttcctccaactttctatttcatttcatacaattttaccacatttctatagaaagaatgtgatagaaaaggaaacatttttcatcgtttacttatttttaccaattgatataacagccgcaatattccgagcggttctttctacatggatagccccatctctcatcgcctcagaaagagaagtgacacctggaacgatactaaaaagggcatcaatgccatgctcatgtacgactgcactatcttttgagagagagcccgcgatgccgatcacaggcaggtgatactgctttgctgctttggctacaccaattggggtttttccataaatggtttgctggtcaattcggccttcaccagtaacaaccaggtctgcctccttgatgacatcattaaactgtactgccttcagcacaatatcaatgcctcgctgcaaatcagcgtgtaaaaagcctaataaactcgcaccaagtccccctgccgctcctgcacctgctgtatcaccaaaggagatatgaagctgttgttctgccacttgtgctaaatgagctaaattcttgtccaatacttgaaccatttctgtatctgctcccttttgaggaccaaacacagcagacgctcctctctcacccgttaaaggattatccacatcacaggctgcctccaggcgaacggattgcagtctaggatcaagtccagttagatctatcgaagctaattgatgaagggctccaccgcctggcgacagctcctgtcctgcttgatcaagaaaagccgcacctaacccttgcatcatcccaacgccgccatcatttgttgcacttccgccaagcccaatgatgacatgctttgctccttgatctagcgccgcaagcattaattccccagttcctctcgatgtcgtgagtaacggattgcgtttttcttgcggaacaaggtgtaacccagaggctgcggccatctctataacggccgtctcaccgtctcctaacatgccaaaaaaggcatcgacggggtcaccaagcgggcctgtgaccacatgattgataatgtacccacccgtcgcatcaactagcgattgaacagttccctctcctccatctgccatgggaagtttgatatattcagcgtctggcaaaatcgcatgaaatccccgttcgatggcacatgctgtctcatatgcagataaactttctttaaatgaatctggtgcaatcacaattttcatcctaaagcccctcgtttcttatcaaatgtcatcagccaaacaactggaaaacgccaaatataatggtcgatacgacggttaatgtcaaaccaattaacgattcaaaaggcatgagcttcaaccgctctttgatatccatatgaacacttcctgctgttgcatggaaaaagctcccgtgcggcatatgatcaagcacagttgaaccagcatgaatcatcgctgcccctgaaagagccgatacgccgaggccaagtaacgtaccgctaaatacgccactcgctactgctgttcctgctgttgtcgaagcagtggcggcagacataaagatccctgaagctggtgcaagtaaatacggaggtaatcccgatgcatcaagtgcttgtataaacacatcttttaaggaagaatttgatacaattcctgctagtgtgcctgtccctaataacataatcgctacacccgacattttgttcagcccagacatcgcataatcattaataaatttcccttttttcatgaaaagagcgcctacaatgcctccgatcggtaaggcgatcattgggtctatattgatttgaaaaagcggtcttaaagccaacaataaaatggtgacaagtggaccgaccaccgctggtaaaaaggcaggtacttgaaactggctttgattaacttcttcttcaagtacaggcgctcctttcttagcaagctttttggctaacacgtatgtgacagctaagccaaatatagccggaatgatacctgctgccatcattgaagtaagcggtacaccaaacgcatcagaagcggcaatggcattcggattcggtgacatgatattccctgctttccctcctccaatcatagcaagtagaattcccgtttttgacagctttgcccgtttggcaatggcaagtgcaataggtgccaccgtgataacggctacatctacaaaaacgcccactgtcgttaaaatcatggttgcaagtgccagtgctaaaagcgctctcgcctctccaagctttttcacgatggcctccgcaatagataacgctgcgcccgactcaattaaaacccctgccagtacacctgccgccataattctaaggacagccggaatcatgcccttagcaccttccatcatgacattgacggtctgagcaatatctacgccgccaattaaaccgcctataaatgcgcctgccagcatgccatacgcaggtgatactttttttagaataagaacaatcgcaataaccagtgccataatggctcccagtgtacttacagtcacatcaccattcatcctcgatccccccaaaattgtctttcttttattgtaagcgtttactaatcggaatcgggttgtgaatctagatgaacttttttcatttatcacttcatctcattgtgcatatgcacaatcaagataattgattcatcaactgcgccatataaagctccatcaactgttttacatgacggggatcttttccggtcaaagcttgtatcttatctaaacgatatctcaatgtattccggtgaatatataaccgatcaacaattctttgtaaatcaccgccctcttcaatgtaacttcttaatgtgtgggcaagttccgcttcttgtgttaatggcttgtaaaagtcagcccaactaccgttttcttcaacagctcctgcagtgatgaatagcctttccagctgataagattcaaaaaaataaatacttccctccggatcaagagccttccctaaccgcaatgaatctctagcgtgttcaaaggacaatgacagccggcatatgtcgtcggcgacagttcctatccccaccagcacctggcctcctactgcattttccattgttctttgcagctgcccaaccacatgctttaaatgatgatcagaaatcggctgccttaaaagaaccaattcatgacgaaaagtcatgccaagcaaatcatccgcattcttatcgtattgaattgcatgcatcattttatgcacagcgtcctctgaggatggaactggctgaaaaatgatggccattcggcgcttatctaaatccattcccagccatgcagctcggttctttagctgatgatcaccaacgtccgaatcagaaattaactgattgacaatctcactctctatccgctgccgccactgcactcgttcaagcagaaaagactgctctaacactagctcagctgccattttcaccagctcggcatgatgccgaatgtcctctggctcaccagtaatgccaatcacaccaaccacttgttcacgaaagcaaatgggcaaattgattcctggtcttactccttctaagtgcaaggacgcatcgtggtcaatttccatactgttcccgtttgtgagcacaagtcgtgcaccatcatgtttctgaccaatcctttttcgttcaccagaaccaatgatgacaccatccgcattcattacattgatatttttatctaaaatacgcatcgtacgttcaaccatttcttgtgccaattcagtggttaaaaattgcatgaggcatctctcctgaaggttttttcattcaatgtatcatagtgtcattgcacaataaatgcaaagtgtttaaaaatgagccattgacaaaggtacattgaaaagtgtttaatcaaatcaaaggaccgaccgacagtctaatcaaaagaaaggatggctttatgagaaccgttaaacatcctgaggaacgtaaaaatgacatcttaaacgcatcagaagagctcttttctaccaaaggctatcagcaaacaacgattatcgacattctgaaagctgttggcattgcaaaaggcactttttattattacttttcatccaaagaagaagtgatggatgccattattgacaggatcatcaaagcagatatcatcgtggcaaagcgtattgcggcagagccagcccttccagtcgtcgacaaactatttcgcatcatcatggcgcaatcgccaaagcaaggaagcaataaacagggcatgattgaacaatttcaccagccttctaatgcagagatgcaccaaaaaagcttaatcaaagcgattaaagaactatcacccgttttagctgatgtcattcagcaaggggtggaagaaggaacatttaaaacgaattacccgcaagaaacggtggaattccttcttgcttctgcacaggtcatatttgatgagggcctttttcaatggacagccgaagagagtatgcagcgagcgctagcttttatcgatatcctcgaatcctcattacatgcagaaaaggggagcttctcctttcttctgaaacgtttaactggagagcttgatgaacacaaccagtgattggtcacttcaataccaatcctgcatacattatagactgacggtcggtctataaggagagtgatacccatgtctttattatctaaaagaggttcatcccactttatttacctcgtgctcggacagattatttccgtttttgggtcttccttaattcggtttgttctatctttacatgtgctggatatgactcagcgtgttgacttatatgccttactattcgctttatccaatgtcccgctccttctttcccccttagcaggcgcaatcgctgaccggtataacagaaggaacttgatgattttatttgatgttctcaccggcatcatgattctggctttttatttttggttattctcaggaaatgattcactctttatgatcggagcggtcatggtgcttcttggtgtgatgagtacgttctatgctcccgctgtgatgtccagcattccacagttagtaaaacaggaacacttagaacaagcaaacgggatcgtcaatggcgtgcaggcactttcaggtgttctcgctcctattatcggcggagttctgtacggactgattggaagtcaatccatcataggtgccagtgccatcgtgttttttctatcagcatgcatgcttttacggttaaacatctccttctcccctagccccttaacggaaaatatgggcaaagtgctcgtaaaagatatgaaacaaggattttcctatattggcagtcagccatttttaaaaagagccatgttgcttgctgcaatgttaaatttcattctcacgccattttttatcgtaggtggtccaatcattttaagggtcacaatgaaaagcagtgacatcatgtatggtgtaggcatgggcttaattgagttcgctgtcatcgcaggagctctgctagttggacttgtagcaaagtattggcgcatccctactttatatcgctggctgatcgtcatcgcgatcatcttgctacctgtcgcattctcaacatccaacacagctcttcaatttggcacttatccagcttattttctctttctagcaggatgtcttccaattgctatgctgcttacaatgatctcaatcgttgtgatttcacatgttcaaaagaaaacgccaaatagtcaattaggaaaagtgatggccaatctgacaatggtttctcaatgtgctgccccgcttggtcaaatgatgtatgggttcttgttcaatacgttttcagcaaacatgtatgtgacagtactaatagtcagtactttcatgtttgcccttgcctatttaacaaaaaatatgctgaaacatgaaggagaatcagccttatgagactgacgtttatcaagaaagacttaacccgccaccgtctcatttccatcggtttaatcatttgcattatgatgacatcatttctagcaacaagtgccgctcaaatgacagtacagctgaatggttccatttctaatctgctccattcagccaaggcaccagactttgtccaaatgcatgacggcagcctaaaggaaaaagatattgaggcattttcaagaaagcagtccatggtaaaagcacatcaaatcgtcccaatgattccaattgaacatgcaaatatcaagttcggaaacgaaccctccaaagcaggtgtgatggatcatttatttgtaaaacaaaatcgttattttgattttcttttaaatgaacaaaatgaaaagctcactgtcagtaaaggtgaagtggctgtgcctatctactttcagcaaaggtatcatctgaaaataggagaaacgttactgattgggaaaggggctcatcaattctctttccgcattaaagcattcttgcgagatgcacaaatgaaccctagtcttgttagttcgaaaagattccttcttcatcacaaagattgggacgcaatgaatcaagtgtttcataaaaaggaatatttaattgaatttttactgcatgatgccgctcaggcagatgcctttcaagcaatctaccagtcatcacagcttccacaacaagggccagctgtcacattacctttgctgcgtatgctgaacgcattgacagatggaatggtgatcgccattctcctacttgtttgcatgctgctcatcggtatagctcttctctctcttcatcttgctatgactgcttctatagaagaggacgaacgtgaaattggaatattgaaggtgcttgggattcctttaacaagaatcaagcaattatacgttggaaaatatgccttccttgctagtatagggtgtacagcaggatatgggttaactcttatatttggtgatatgtttacagccaatattcagcgatacatggggagtcagccttcttttacttcttggttcatcccgctttgtgtttctattgtgatggcagtgatcatcatttcttgcagctatactgtcctaagaaagtttggccgagtatcagccgctcaagcacttcaaggcagcgtcatttcaacgaatgataaaaaacaaatacccttgcatctcaagaaaaacaggttcatctcagtcaatatttggcttggtttaaaagatctgttatcacgaaagaagttgtacacaacgattacttgtattatcgccctttgtacatttttgatgctgctgcctattcaactatggtacaccttacaatcaccggatttcatcacatatcttggctctggtcaaagtgaccttcgaattgatatacgacaaggaaatcatctagaagaaaatactaataacatagaatcaatgatccgtgaagatcgagatattcatgcatcagccatatatgaaacaacctctcttcaggcaaaatcaaaggagaattcattagaaacactctatttagaaacagggaatctctcagcatttcctctcacctatttacaagggcgacagcctttaaagaagaaagaaattgccttatcagttctcagttcagattcactccaaaaaaagataggagaaaaaattactctcgtaacaaatggacaggaaattcaaaaaactgtgactggcatttatcaggatgtcaccaacggcgggaaaacagcaaaagcaataacacagccctttcctcaatcagtcctttggaaaaccattcaaattcaactaaaccaaggaatagaaattgcggagaaaaagacagtatttgaaaaagagatatctcctgcaaaagtgacagatatgaaagaatacgttcatcaaacaatcggcagcacagcatctttagtaaaagtcgttgcatttttgtctatattagctgcttttggaactgccagtttgatgttattcatgtttctgcatatgttaaaagcaaaagattcaagtcgaaaccatttattacgaacgattggattttctaaaaaagatgtaacagtacaatatatgacaagttttatcgtcgttatctctttgggcacctttattggcacgatcgctgtccacacaattggaccagctttaatgagtgtaggtggagcatccttaggggcatcaagccttcagtggctggcaccacaatgggtgtcagttgtgtacccaatcacactgttgattgtcagcttagctttaaccgcttcgttattgaagacgttttttactagtcaaactactcgtcatacactttcataaggagatgtttcacatggaacacttgattgaaacaaaacgattgtctttgcaaattaattctttaatcattcttaaagatatccatttatcgatacatcctggggaatttgtgacgattatgggcccttccggatgcgggaaaacctccttgctttatcagcttagcgggatagaaacagcctcaacaggagagatcaaatataagggccatttattatcagaaatgacagataaacagttaactgctctgcgtttaacagatatgggatttgtctttcaacacagccacttactaaaaaaccttaatctgtttgataacatcattgctgcagcttacttaacaaagaagaagccaagaaaagaagtgaatgaacgagctaaatatttaatggagaaacttgatattgatcatttagcagatagatatttgtcagaagtatcaggaggtcagcttcaaagagcctctatctgtcgagcgcttatgaatgaaccagacattctttttgctgatgaaccaacaggtgctcttaactctcatgcatcgaaggatgtgatgaatatattttcgaaaatccattctgaaggagcaacactattgcttgtcacacatgacccaaaggttgctcttcgttctgaaagaatcatgtttatgaatgacggagaaataacagccagcttacatttagggaaatttgatgaggcaagtgccgagaaacgggagaccagattaaatcaatggcttcaagatttaggtttttaagttggaataaaacaggcagctttctgcctgttttacttttcctgacactcaaatgaataatccatagacaaactattagtttctaatatgattttgccgcctacttgttggcaagattctgtcagcaattctatttctttgctataaaaatatctctttgacatataaagagtcaataaaacaagtaacagtgtcgccataatcactgtgatttgccagtttaagattttaaatctttttttcatatcaacatccttcccaacagactagtgtttgtgcttgctatttattttgtctgcttctatcagtttctattccaaatttgatctagcatcatcataactgatttcctttaatggatctaccttccaacttacccacagatcacccaaaatctctttatttgtaatataccagtgatattttcgatcataatcataaaacccattgtatatattcctttttcagacgattaaaaaaagattttaatcatttgtaaaaacattcaatcatcattacaatttcgtacatcacatgaccataggtcctttttattacctcttggcaatcacctcacagaaatgattatatttttccaaaaattgtgatatcgttttttatgaaacaggtgaaaggatcttaaagaggtgaaatttcatggctatcatttctgctgaacaggtggggaaccgtttaaatgattggcgaattgcgattcgcaaacatgatgtacaaagtgctaacgcaatgtacacagaattaaagcaattgcttcaagaaatggaagagaatcaggaggtattgacgtattattcattgctagaaggcaagtataaactcatgatatatgaacgaagaggtaaaaaactgaatgaacagacagagctagattgcccctctaaaacaaacgacttaattgaatactatttttacctatacaaagccctttacgcttcatataacagagactatgcatcagccattggactgtttaaaattgccgagaaaaaactgcaaaacattccggatgaaatagaagtagctgaattccatacgaaaatcgccaacttatatatgctacttcgtcaaagcctaatttctcttcactatattcagaatgctatagatattttcaaaagtcatgaaggatatgaaagaagactagcgacagccattgtcatcgctgctgctaattatatggatattggcgacttcacaagagcagaaaactactacaaaaaagcattacacatcgctgacagtctaaatgatcattttctaacttcacagctttttcataatatcagtattctttatgccgaagctggagaatcgaaaaaatgtatcgatgccctagaaaaggctctaagtgatgaaaactacctctcatcgtgctatttccatcacaccatgtttatgttagtcaaagagctgctctctattgatgaaagaacacaagctctctattacttcgaattggtcaaacaaaaacatgaatcagagaaatgccccatctatacagcaaaaatgaatttgctttaccatctatactttactgaggatatgtctcaaaaagctcaagcctgtttcgaggaaatcagtattctaaaagaattaaaggatgctgaaggtgtctgtgaattaagtgcactagctgcaaaacactttgaagatttaggtgccattcatcaagcctatctctttttgaaggaagcttatcacatgaaccatcctatatttgaatggaggaattctaatgaaaaaaatgagtttattgattatcgcattaaccatcgtcgttttcggacaaacagtgtctttcaattcgttaaatgagacgaattctggcacaacagaacgacctatcggaacttaatataaaattgatcacagcaaagaaccacttgcccgatcacaaggcaagtggttccaccattattttaattgctgataagatatgaggcggtgtatatgtaccgcaagataagtaagctcatcattaggaatgacgatactatgcacctgtttaatataatctttgattttaaaagcaacatccatcgcctgaggatacaagtgtgcaatttgttcaaacaactcattttcttgatccaaaagtaatttatttgcataaaacctctctacaaagaacttcacatgtgtaatgaaccgactgtaatgaatattttcttggtccattttcatattcagtgtatagcgcacaagattgacaatgcttccgatcattttggcatatttcatgctatctttcgaatcggattcttcacctaatgcattgattaagtgaaaggcgatattggcagcttcttcttttggcaattgtatgcccaatgtatcattgactaactcaagagcgtacttccctacttcaaattcttcagtatagtaatttttgatttcccagtacacgcggttcgtaatattaatattctttttatgtcgttcaacagcaaaattcaaatgatccattaaggtaaaataaacccctgaatttagatttgaatttaaccgtttttctgcatattggacgatgcgctgagttaaatcgataaactcttgaggcattgaatctaacaattgaagaaattcctttgctctcatgttatcgactgacataaagacttggtccgcttttttctcttctatcatttgacccggtttctgtccgtagccaatcccacggccaaacaaaaccatctcctgttggttctgatcttcagccaggaccacactcgagtttaaaacttttttgattttaaacatcgtcatcacctgttttcatgattgtggtgttcaatcaagcgattcaccatttgtctcaatgactttttggtaccaataaaatgagtcttttcgagatcgttttaacgttccgtttccatcatcatcttgatctacgtgaataaagccatagcgttttgacatttgtgatgtacctgcactaataatatcaattgagccccagctcgtatatccaaagagatcgacgccctcttcaatcgcttctctcatctggcggaaatgctctttaaaatagttaatccgatagtcgtcatggatagagccatcactttcaactacatcctttgcacccattccattctcgacaatgataagaggtttttgatagcgatcatacagttcaattaaagaaattttcagaccaaccggatcaatttgccagccccagtcagttgaaggcaggtaaggatttttgactccacgaatcgtgtttccttctgtctgttctaacccttcttgagctgattcagttaaagacatatagtagctaaatgaaatgaaatcgactgtgttttcttttagaatgttgaggtcttctgcctccatatgaatatgaatattttttctctcaagcatccgtgtaatcagtggtggatattcgccaaacacctgaacatctgcatagaaatagttttctaagttttgttttaaggcttgttccacatcattcgggtgacacgtatgcggatacgttgtcaattttgtcagcatacacccaacctggctgcctgggataatacgatggcaatcagctgtgacaagagcagatgcaacaaattgatgatgaagtgcttgatacaccgtctcttctactttaccttctgggcaacgatcaggaataattcctgctgtaatgaatgagtggcggtgaatactatcaatttcattaaaggtgagccaatatttcacatcatgttgataacgttcgaaacatacattggcgaacttcacaaagagatcgaccacttttctttccacccagccgttatatttcacactaagagctaaaggcatttcataatgagagagtgtcacaatcggttctatattgagttttttcatttcggcaaatacacgatcataaaattgcagccctttttcatttggttcagcttcttctccagtagggaagatccgactccacgcaatagaaatgcgaagtgttttaaagcccatttcagcaaatagagccaaatcctctttatagtgatgatagaaatcaacccctctgcgtttagggtactttttatcgtctgggtcttttattgcacgatctatattttcagaagtcacagcaagatgtccttcataatcttctacacttaaattggaacgatacattgcaatatctgcaactgatggtccctttccatctatattccaagcgccttctgcttggttggcggcaatggcgccgccccataaaaatccttttggaaaacctttaattgttgtcatctgtttagcctcctaattgtgtgacaaccatcaatgtatcttgacgattgacctcttgtaatggctgtacctttatttcatattgatctgtatttgtaatgacagcaagtgtaactggatcataacctgctgctatgattttttctacatcaaattcaatcagtaaatctcctgcttgaacacgttcccctgcctgcacttttggatgaaaatactgtccttccagttgaacggtatcaaggccaatgtggaataatacttcaaccccttggtccgttttcataccaagtgcatgatttgtttcgaacagcatggtcacttcaccatctaccggtgcgtaaagcgcaccttctgaagggacaatggcaatcccgtctcccatgacctttgaagagaaaatatcatctttcacttcagatagagagatcatttgaccaatcacaggacttttgaatgtttcacccgctccaatttgttcagcaaatgcagcttgatcatttgtcttttcttctactgttttatccttacctaatacaaaagcagcgataaaagcgacaataaaggaaatgattgctccaatgatagcaaacattagatttcgtgggagctcatctgatataaacattgacatacttgctaatccagggccaacaagtacaaaggcttgtataccaactaatccaatgaatatcccgccaacaaacgaaccaatcatgacacttccaagaactcgcttattttgaagtgtcacaccatacaaagcaggctctgtgataccaaaaaatgctgaaatccctgccgaaatggctgttgatctgagtaccttgtcttttgtgcgtagtgctacagcgaaacacgctccactttccgcaatattatgtgcaagtgatgcaggtaaataaagtgcttctttcccaagggttcccatcgttgtgactgcataagggaccattgctttgtgcatacctgatgcgaccatgaatgggaggactgctgctaaaatcgcgacagctacccagcctactgtattaaacattgcgagaatgatggatgaaaaaccttgtcctgctgtaaaaccaatcggtcctaatagaagtaatgtaattggtacagtaatgaccaatgacatcattggaacaaagaaaatccgaattggttttggtgaaaatcgtgtaaagaatttttccatttgagcgtatagcaatacagaaaggattgctgggaacacttgatacgcataagctatgtttttcacgtcgaatgacagcaattgcgcaccttcagtaagcatagccgtcatgttcggaagaagaagcgcgccgactgctgatagtgcgaccagtggatttacctttagtttattcgccgtcgttacagcgactagtaaaggcaggaagtaaagaggtgcgtcccctaccatattcaatatttgataggtttgaccttttgcatccatccagcctaatagagaaaaaaggagaagaaatgattttaaaatccctccgcctgcgatagctggaacaagcggctggaagacaccgacaatgaaatctaacagaactgtgcctatttttcttttttcttttggctgattggatggcatgacttgccccgatgagctgccacccattagacttgttaccttttgatacacttcaatcacgtcattcccaatcaccacttggcattgtcctgacattctgacagctatgacacctggtgttttttctagtgctggtacatctgcttttttctgatcaattagcgtgaagcgaagtctagttgaacagtgctcaaggtgcgcaatgttttctttaccacctacatgctgtaaaacgtctttggcaacttgtgtataattcatttttcctcccccttttcctcatacatgagacctatattttggcaataaaaaaaggacctaaaacgacaaattaaagaaattcatcgtttttagatcctgcctgcatgaccagtcacatgtctaatttatttatattggatttgattttagtatatattgattatatgaaagcgtcaacatttatttttcagaaatttattaaggtctatatacctaaattgattttctttgatttagttaaaacaacctttctcgcttgtttatacatcgatatccttttatcatcactaagaactatctccattataaaaaccagataagtttactcatctggtttccatcatctatttttttctttcttctgcctgctttttgaatgctttcgcttgtttttggtattcctgtttcgtaaccgcttttaactctacggtaccgcctgtcattttaaatggaagtttgattgattttacatctcgatcagtggaaccttgaatgatcccatcttcaattgaaggctcatggcccattacaaaagttcttccatccgtatcacccatgacttctaatctcatttctttataaggcttacactcttctccgggaacagttgtgattagaaggaagccggaccatccaagttccatatgcatcgttttcacctgtaaaaataattgtttgtcctttgccgtatagagaaagccatatacctttgccactttctccttgaagtttctcatactatcataaaacctatcttccgcggtatcaaatagataatcatattgtttttggatatctttatgatatttctctagctttttttgattgattgccttataaatcgtgcttttcttttcgccttgttttttcactgaaaggttttttcctgaaaaatgaacatcgtatacgatcgtttctttaccttgtgtgactctgaattcatacccattttcttttgaactgccggatacgacaaattgttttttatagatatgcggataccatctttcttcttctatatacttttcattcaaatgccctgttactttccctttgctctcagataccttaaaccagctcatgctatccttcgttttatacgcaaatgcataggaatgattcaatgaattcttttgtgcgattgcttgatatgctgtccagccgcctccacctaagatgagtactgccaggatagacacgacccacattttcaatttactcatacgtacctccactaatatatgatttaaaaaaccttcatgatccctatttagatattcaactaaattctgatcgccctgaaatgccattcacaacattcatctgttccaacacgatctacttttgcaattctttcgccttctttttgaattcttctgtttgttcttgatattcctctttcgtgaccgctttaaattctattgtcccgcctgccattttaaaaggaaatttaatgtatgttgcgtctcggtcagtttcacctaaaataaaacccttttcaattgcaggataagtactcaaatcaaacatcatcccatctgaaactccaccagctgtatgtttcgtttctttataaggttcaccaccatctcctggggtctttctcattagaaaagaacctgcccattcagactgcatatacattcgttttacttttagaaatagttggtacgaaccatcctcttccgtatacagataaccataagcgcctgttactttcttaatgaagtttcgtacataatcatgaaatctattttccgtgtcatccatcagtttctcatatcgagtatgaatgtcctgttgaacagcacgtaggtttttttgatcaactgctttgtatgtgatgctgtgcttttcaccttgttttttcacagaaagatccttttcggcaaggtgaacttcatatgtgaccgtttctttcccttgcttcacataaaattcgtaaccgttttcaattgatttcccagttaattgatatttgttgataaacatattgggatcataatgccttttcggattttcctctaaaatggtttcattcagatgacctgttacttttccgtttctttccgttaccttgaaccagttcacacgatcatgagtcttatatgcaaaggcgtagggatgattcaaagcactcttttttgcgattgcttgataggctatccagccgcctccaccaatcagtagtaccgccagaatagtcatgatccagatttttgatttactcatatgtcccccccaaactatgatcgttcactctatatgaaggattcatcttattgattaaccaatcagtgatctcttcacctcctttctagcatttatttttttctcatacctcttgtatctgcagatatacatcgtttattatatatctaaatgatatatcttttagataggtgtgttgatcaatgaaaaaatacaatgatacgacgtatgcgattttggggattttaacgacagattgtaagtctgggtatgaagtgaagcaattaattgataggagcttgcatcacttttggaaaattagttatggacaaatttatccagctttaaagttaatagtcgaggaagggcttgcgaaggtttcacccgcttctacaactgggcgctcagacaagcgggagtatcatctgactgaaaaagggctggacacgttgaggcaatggctggcgcagccgctcgatcaagtaccatcagaacgaaatgaagtgttattaaagttattctttggtcaatatctttcgtttgagaaaaaattggtgcttttacaggattatgagaggcagctccgtatccgttatgagacatatgttgcgattgaacaaaacattcaagagctgtatccagatgaagctgatgcgaagtattggctgtatacgttagattacggaaagaaagtggcgcaggctggaattgattggtgcgtggagacctgtgaatcgatgaagaaagaagggtgaacaagtgaaaaaaaatatacgtgctggcaggtatacaacagacaattctgagccgattgttgtgttcattatcggaatgagaattaataaacgctgggctgtccatcaatggctgccagtatttaaggcgatgccggggatgatcaaagaactttatacacatcaagaagaacttggttttctagggacagaaaattacttcggtttacgcaccaccaccatgatccaatattggaaatcaacagaggacctccttgcctacgccaagatggagaagcatttggctgcttggaaaggatttaaccaaagagcacgaaataatgacgcggtcggaatttatcatgaaacgtatcaaattcaagccggctcatatgaatctatctacgtgaacatgccttcatatggattgagccaagctaaagcgcccatcctaattggaaaagggaaaggaaaagaaaccgcaaaagaacgcctttctacaacaaattcctagagctgattctctaggaatttctttttgcaaccatcacaaaatgttttaatatgcgggcagttaatccccaaatggtgtaacgatcgtaatcataaaaccactcctcaatcgaacgactcccccagctgtatttttctccgttcatgattttttcataaggaaagtcctctcctggtgttggctgcaccgatacatggtgtaagtacggttcgtattggatgagccatgatagaggcacagtaaaggtctcctctacttcttcttgattaaaggaatgtttgacctgctgttcatcaatgattccgacaaatggatataccacaaaggatggagaggcaatataaggactgagccgtcctaacaccttgacggattcgggcggaatccctagttcttcatatgtttcccgcaatgcagcttcctgtgcggtttcgccgccgtcgagtttgcctcctgggaagctaatatcgccaggctgttttctcatcgtcagtgatcgcacttcaaataaaacatgccattccccgtttacttgcaccaaagggacaaggactgccgctttgaacgctgtttcttctccaataaataacggttgagattgatgtaagtcattttttaattggtcaatgaacacgggcatcacctattttctgtttctctttcttttagcgtatcatggttcatcttttgaagaaagatgatctttctgacaattatttttatcaatttgacaactttacttgtcaaattgaataatatgctttacaatcaaagaaagattcagatcaaattgaggtgacagaatgaaaaatcgattaaaagagcttcgtgcgcgtgatggtttgaaccaaactgagcttgccaatcgtgcaaaagtttctcgtcagaccatcagcttaatggagcgagatgaactaatgccatctctcttgctcgctgttaagctttcacgaatttttcaggaacccattgaacgtatttttctattcgaggaggatgaactatcatgaaaactgtatacaaaatgctcttaggtgctctccttggctttctcggtgcttactgtctgcttgcagctgaatttgagatgacccttcttgatgttgcatttgaagcgactcttgtcatcagcggcttgacgattgtattaattgtttattgtttttcagggatttcacgtatgaagaaaagagtatcactttcggtatctggagatgaagaggatgaactcgaagtaaaacagtatcgcacctttactgattcgactttagccaatacggtaagtaccattttatccattattgccatcggtatggctatcgtcaccgaacagcctatttggctgattctcgtcaatgttgctatatttatcgtcaccattatcagttcttacgtagcaatatccgttctaaaacttgtctaccctaatcgcaatctcccaagcccttctgacaaagattatagtaaaaaactgcttgctatttccgacgaaggtgaaaagcatgtgatgcttggcggattgtttcacacgtatcaaatgatgaacatcttattgaccggtgccatgtttattctgatcgtgtattcccttggagccaatcactctcagctcttttcaatcatcgtgattggacttgttttaattattttgaatgcaaattatatgttcaggattagaaatcgttaaataaacaaaaagcacagcctagtacaaaggctgtgcttttttctgtccattatgacgcacggcgtttctttcgtgcataaatcaataataagaaaccaaaccaaaccggtgttaacaagagcgccggacgtgttgcatccgcaaacagcatgatcacaagaatggcagcaaaaaggacaagaacacaaatgtttacaaaaggtgtgaacggtgctttaaaggtagatgctgcatgcagttcaggctttgtttttttatatttcaaatggcaaattagaattatactccatacccaaatgaaacaaatggcgctgatggttgtgacaataccaaaggcttgttctggaatcagcttgcttaaaagagcaccgaccgaaactacaatcgttgaaacgaatagtgcattacttggaacagcgtgcttgttcaggcggccaaaggaagatgggccctgtttttgatgactgagattatacaaaattcggctcgtcgagaacataccgctattacaagcagaagccgcagacgtcaagacaacaaaattaatgagtcccgctgctactggaattccaatcagcccaaaggttttcacaaaaggactttctgatgcactgagctcagtccatggattgatacacagtaagacaaaaatggcgcccacatagaaaaagagaattcttaatggaattttattaatcgcagatgggatgtttttttgcggattggctgtttctgctgcggacacaccgaccagttccactcccacatacgcaaagatgaccatttggaatgacagtaagaagcctgtgacaccatgcgggaatagtccgccgtgtgaccaaagattcgttaccgtcaccggccctgaatctgtttggaaaccaatgattaaaaggacaattccaactccgatcagcaatagaatcgtaatcactttaatgagtgcaaaccaaaattccatttctccgaaaagcttcactgttaataaattaaaccctagtaaaattaacaaacaaatgatagcaggaatccattgcgggatgtcaaaccaatactgcacatacactccgaccgcaataacatccgccatcgcggtcataatccagcaaaaccaatacgtccaccctgtcacaaaggatgcccacggaccaaggtaatcctctgcaatatcggttaatgactgatagcctgtcttcgataagagtagttcaccaagtgccctcatgacgaaaaagatcgccattccgacaattaaataagcaaaaatgatcgatggacctgccaattgaatcgcctttccagagcctaaaaacagcccagttccaatggttccgccaattgcaatcaactgaacatggcggtttgataaatctcgttttaattcttgttgttccaatgctaacgccctcctacgacacgatcttatactgaaataatgaactctcaaaaagtccataaaaaaagagattggatgcgctccaatctcacggtcataaaagaatagcaaaatagagaaaagcaatacacggcttcatccatgcattacaaatacaatatttcgtactcttctgtccttttgcctgagattgtgaacccttcggcgccgcacatacatgcggtctctccagaagctgctcctgctatagtgtgacccacagcaatcatagccttcgttatttaattaaaatgttgctatttctgaataatttcatattttacgcctctaaaagaaagctgtcaatggaaatcttttatgagtgacggtggcagccatataacttcacttcatcaatcccccttgattcatgtataataaatcaaaagatgttcggctcgtttgatggagaaatccctcttgatcaagaacaaagttaggcaatccatggaagttggtgaaaacaaatgaaaaaaatgaacaaacagcgtgtcacattacaggaagtcgccaagcatgccggtgtttcgacttcaacggcatcacttgttgttcgaaataatcctagaatctctgaagccactcgaaaaaaagtactgcaatccatggaggacttaggatacgtatacgaccgcgttgctgccaacatgcggtcaaaaagctcaaatatcgttggcgtgattgtcacggatatttctaacacctttatttctgagtttttaattggcgtgcaaaccacacttgagtcactgggctatactgttctacttggtacgacctttgacagtgtcgataaacaggagcggctcatttccacaatggtagagcaccgagtgggcggaattattttaaacccagcttcaaaaagctctgcacgaacggtcaaacaattaaatcaaattcgcaccccaaaagtactggcaaatcgtgaattatcagatgtgcaatgtgactatgtcggtgttgattatgaacaaggtgcttggatggcggttcatcatcttcttcaaaaggggcatcggcgtatcgccttcttaggcggcatcaagacctcatcgacttggattgagcggatgaaaggtttcaaaaaagcccatgacgaagaaaatctgacgattgatgattctcttattattgacatagaacctactcgtgaaggcgggaaagaagcacttggccaagtgcttgatcagcctgagcctcctactgctattttttgttttagcgatctagtcgcatttggggtcattcaagaactgtcagcacgggacattaagcctggtgaagatatcgatgtggttggattcgataatgttcctgaagcggagatgtaccatccgccgctcaccactgtttcctccttcccccgatccatcggggtaaaagcagcgaaccttttatatcataaaatgaacgaacaggatgaagaactgcagagattgatcttaaagcctcaacttcatattagagaaaccgctccctcatgatgaaagagagaattgcatgcagcaattctctttttttattgatcaagtcaatgatttctttgtttcattttcctttttttaaatcacaaagtcataaacttgacacatttaaaacacaggagtatatttatctcgttgcttcttttagtatatcgttatacctatttcatcttatcgttatttctattaaaaaacaggtgaaattgattttttatgattctgatcaaatcatgaagtgtcattttctaatcaagactggtattattttttacattttagtagaacgatgtacttaattgaagaacagatgaatattcattattttactcatcaatcacacaaggggtgttgtgatggacttatgtacatgtaaggaaatatcaaagggtatacaaagaatttaaccttaaaggggtttcaaatataggagtgggaacatgaaaaatccttatattaaatcatcacttggaatgtatttaaactacttcatgcttggcatgatcaatattattgtagcttctaacatggacagcttatctgaacgttaccatgtagatattccgaaaatcagcttgcttgtatcggcgatcggaattggtaaactcattgctctctttttctcaggccggttagccgacagttggggacgtaagcctgtcattattacaggaaattttctttacttattattcttaatcggtattccaacgacaacgagttatacactggcattcatccttgcgatttcagcaggtattgcaaattcactgcttgattcaggaacctatcctgctttgacagagtcatttccgaagaaagcaagttcggcttctgttttagtgaaggcgtctgtatccattggtgcgactgttcttccatttatcttggcgttcctagtggcacatgacatcttttggggctgggcgttctttggactaggacttctttatttacttgttggggtttacttaatctttatgcccttcccgaaccataagcaagtttcttcacaagacgctcttccagtacaggagcagctgaaagaagaaccaaaaatgcttggcgaaggcttagctgttgtactcatgggattcacgtcaactgcattgtttgtcgtatggcagacatggcttccgcagctcgggttaaaattaatcggacttggcacagaacaagccacacagcttctatcttattttagtatcggtgcactggtatctgttctcttgctgtcgatcgtcttagataaattcatttcaccgattatggtagcgatcatttatccaattggggcgttccttgcaatgctttcacttttccaaatcgaaacatacagcattgtcattatcagcacttttttcttagggctatttacagcgggaatcttccagctggcgatgagtatcatgatgaaactattcccgacaaacaaagcaacggcttcatcctacgtcaacattgcggcaagctccgcgtttattctcgtaccgctcattacaagtggattggtcagcacgtacgatattaaaatgacgttatttttcgatatgatcattgcggttatgagcgtattgctagcggtctttgttcttggacgcatgaaaaaattatttagataattaaggagatgtcaatcatgacaaacatacatgaacgaaatattgatgggaaaacaaaattagttggtcttcttgctacaccaatcgggcacagcctttcaccacggatgcataaccttggctatacactaacaggtatcaactatgcttatctcgcatttgaagtagggaacgatgaactagaagcagccgtatacggtatgaaagcaatgggtgcagctggatttaacgtctctatgccgaacaaaatgaaagtactagattacttagacgaactagacgattctgcaagatacacacgtgcaagcaataccgttgtcaacaaggatggtaagctcatcggttacaacacagacggtcttgggtatgtgagaaacttgattgaacacggcgttgaattagccggtaaaaaggtcactctcgttggctctggcggtgcggcgactccgattgcgattcagcttgcacaatctggcattcgtgaaattagtattttcgctcgtaatgatcaatactttgttcaagcagaagaaaatgtaaattatatcaacaacgaaatgaaatccttcggtgtcaaagcaaacattttcccacttgaagacaaagacgcgttccgccgtgaagtagcagaaagtgcgatcctagcaaatgggacaagccttggcatgaaaccactagatcaactcagcattatcgatgatacacttgatgtacttcgtgaagatttgatcgtgactgatgtcgtatacaacccgcaaaaaacaaagcttcttgcgcaagcacaggaagctggcgccaaaaccattaacggtcttggaatgatgctatggcaaggtgcacttgcttacaaactctttactggtgaagatatgccagttgatcaagtaaaacaaattctttttgaaaatgaccgattctaatacaaaagaaagacgacttccctgaacggaggtcgtctttttttaatcatgtaccatgatttggcggtatcgatacaggatatacaatgcgccgataatggccgcaacagccaccactgcatcgaacataaagatttgtaaaatggacgagtgactctgaattaaacctgttacaaccgggatgacaatagctgacacgccgcccgccgtggagataatccctgtcatcgtccctttgtttttccagaagaattcagccatcacagttaacgtcagctgaaagactcctgctgttgaaaatcccaatacaaacgcattgatggttccgatgactggagatttcacgaccaaaagtacacaaatggaaacaagcgtaatgattggatagatcagcagcacagtgaccggacgaacaaaacggcgcaacagaaatgcgagcatcacgacagacagcagcccgcccatgctatagtaactgagcagtttcacagcactgcccgatgccatccccaatatagcctcaccgtacgtaggaagccaaatttgcggcaaagcatatagcccatttgacgtaaagctgatcacaatgagtgcgatcccttctctccaaaatgtaggctctgtcgagaagcgcggaagtccgtcatggtccgttacctggacttgttctaccttgcgatgattcggaaatggcaaggtccacagcatcaagacattcacaaggtagatcagagcaggaacaaaaaatgccattccataaaacaaatcatgctctgccaaaaagaaaatcgcgagtggcaaaatggttgccccaattgatataaaggccttcaccatcacattcgcagatcccgagttttgcgggaaagcctccattaatgcaggatacgtcccagcatccatcgctgaattcgcgactcctgccaaaatcgcaaacgcaaacgcaatttgataattcggagacaatggaattccgatcaggaacaccgccatgagcacacccgaaaccaaaatgaccggcttccgcccaaaacgatctgacagcacgcccgataaaccatacgtaagtaccctgccaatgccaagcgccgaaatcatataactaattcctgcactattggtatctaactgtttgattaaaaatggcatattggaagccaaaattatattgaccatacctaataaaaagtaattaatatacagactagaagccgttctcacatacggattcctcatcctgacacacccctcaacgccatcgcaatgaagtgaccgcttataagatctcatgtgtgaggaagaacagctttacagccttcacgttcatacatctcatcatgtcatgcagctcgcagcttacatgcccttcatgtatcaagcatttcttcaatttttcactgctcttattttatatgaatgtgaaaagtaatgatagtgaattgcttaaatttgagggaattgagacgctctcggtagtggtttccatgtatttgaattttatcttctcttgattgaaggaaagtaaaaaccttttgacaaaacaattgattttcttcgatatctaaaaatacgtttcctggtagtgtcatatagcttaattcgttcattaagtgctttcttctgcttcttctttttaaggtgtccatttttgctttagagttattcatgttagcgaccttaatcttccctttccatctcgtacttatcattacgatacatacttcattagaaaattcattacatcaaatcatgtaataaaacctattcatatctttatctcttttcaacctctgcagcgatatgagacaatgctaactaaaaacaaaccactctcaaaaggagtatccatatgtataaaaaaattattcctgttgttatggtaatattcgtcctttggattcttcttcaaatatccttgaacatgaatatccttcacaatccaatgaactattttgtcgctattactctcttttttctttgtattcagtctctattaaaacataaacgatgaaaaacccgaacaagcatataccacgctcatccgggcttctattattttctttattacacttcttcaccattcgtggcaatgacgttttggtaccaagtaaacgaatcttttttgagtctcttcattgaaccgttgccttcgttgtcgcggtcaacgtagatcatgccgtagcgttttttcatttcgcctgttgtgaatgacacgatgtcaatgataccccaaggtgtgtagccaatcaggtcaacaccgtcgtattcgatggcttttttcagtgcttcgatatgagaagcgagatattgaattcgttctggatcatgaatggaaccgtcttcctccacttgatcaatggcaccaaacccattttcaacaatgaagagcgggatttgataacgatcgtaaaaacgattcaacgtatatcttaagcctgtcgggtcaatggaccagccccagtcgcttgatttaatataaggattatctacaccatgcggaagggctccgttgacaatgtctccgtcgttatcagacaccgcatcacttttaaccgttgtcgacatgtagtagctaaagccaagataatctactttcccttttcttaagctttcttcatcgccttcctcaaacggaatatgatagccttcgcgttcgaattctttcagtgcatagctcggatagtagccccgaacttgtacatctgggaagaaatagcgttgtctcatatattcttcagcaagcatgacatcctctggatttgaggaatatggatagattggcacatgagataccattgcaccaatttgaaaagcaggattgatttcttttcctttggctactgcccatgcacttgcaagtaattcatggtgtcctgcttgatacatgacttctttggcattttcgccttctttgactgatacccctgaatttgtccaaaggaacagtgggttgttgacatccattttgttattgatttcattaaatgtcatccagtatgtgactttgtccttgtatcgattgaagcacacttctgcgaatttcgcgaagtattcagcgacttttcggcttctgaatccgccgtattctcttgccaagtgaagcggcatctcaaagtgggacagcgtaatcacaggctcgatgccatgcttgaggagttcatcgaatacatcatcatagaattgtaaacctgcttcattcggttccgcttcatccccctttgggaaaattcggctccagccgatcgatgtacgcaggcattttaaccccatttcagcaaacatcgcgatatcttccttgtaacgatggtagaaatcgattgcttcatggttcggataaaatttgctgtcttctatcgtctccgtcatttgtctcggtactccgtgagcaccagctgtcattacatccacaacacttggaccttttcctgcttcattccatccgccttcgaattgatgtgcagctaatgccccgccccatagaaaatcttttggtaatgtcattatctattcctcctatttcacaattgtgatcatgacgtccgttggctgtatcaacactagtatatgtacattataattataccggtacaatttatcaatacatatataatttcaattaacatatcaaagaaaaattggtatgtgctataatcaaagacaataaatcgtgaaaacaaagaggaatagctatgttaaagtatcaacaaattgcgagcgatattgaaaaatatattgtcacccatgagctgcagcaaggggacaagcttcctgtactcgaaaccctcatgagccaatttgctgtgagcaaaagcaccattatcaaatcattagacttactcgaaagaaaaggaattatctatcaagtgaggggcagcggcatctttgttcgaagacacaggcgcaagggctacattagccttttatccaaccaagggtttaaaaaagatttagaggaatttcaattgacttcagaggttttaatgctagacaccatcaaaccgcctgaagaagcagcgcttaatttgaatattgaagaagatgatgatgttttttacctcaaacgcatccgctatatcaatggacaaaccttatgtctagaagaatcctattaccgaaaaaccatcattccctatctcaacacagaaattgccgccgattctgtttttaaatttatcagtgaaggccttgggctcaaagtcggcttttccgatatgtacttgcaagtaggtaaactaaatgaaatcgaagcaaaacacctcggccttaaacaagacgatcccgctctccgcgtcgaaaccgtctttcatctcacaaacggccagcctttcgatttctcgaaaattacatataactacatgcaatcccaattttttattcaagcgaataattattatgggtgatggttggaaaaagcctcctgagacattcaggaggcttttttacgatttaccttacaacctttaaactttccctccttcttttttgagaagaaagaccgtcaatcgccacatcaccataataaatgtctatgtgatctcctttgccaattagagcaactggaaaagcatgctgttcttgcagacacttttcaaactcatctggatgaatctcgacttcaatttcatgtccaatgaacgcatattcaaacataatcgtatgataaagattcacaagacagcgtatgatctcctgctgaagatgaatgtaatcatgagaaacaacctctgtccactttaaacagataacaaaccctacataacctgtttctttttgtatgttgatggtcatatcatttagcttcgaccccgacaattcaaactctgtataataacctgaaaagttatcatctttgatgatgttctcttttatactttgttcaatccctatttcgccatcagaatccttactatactttactttggtaatagacatttctttttcagctagataatcagccaattggcgaaaagcatttggtaaatgaatggtctcataaaaaacgatgccaatattgatgtatccacctatagctatcatgcatccctcgctttattttttctttcattatactttactcaaacctgtattctgagaaaactccttcacttacatgaacacttccgatttaaagtatcaaaaagattcattttacgaatgcattaatcaaacttatgataaacgtaacaagaatgtatagggggattcattatatgagagatgttagggtgtaccatgtcgatgcgtttacaactgagaaatttggaggaaatgctgctggggtcgtgttggatggtgatcttttaatggaggatgagatgcagagcattgccaaggagttgaatttaccggaatccgtcttcttgctgcctgcccatgataaggaagccgattatcgcgtcaaatactttacacctacggaagaggttaatttctgcgggcatgcgactgttggattgacttggcttttggcgacggagcttgggctggcaaaagagaaaacaggggtcgtgttagaaacgaagattggcaaggttcctgttgtgtggcacgaagaaaatggcaaagtcatcgatgtggaaatgacgcaggtgacaccggaaacgcgggattttataatcgatttagaagagcttagtgacatgcttggtatcagcagtgaccgcattgatccatcgtatcctatcaaattagcaaacaccggaaactggcatcttctcgttccgatgaagcaccagcaagacatcgatcaagcggcaccgaacttagccgctttagggaaaatgaataaagaacaaaatatcacgacgactcacctttattcatttcacaccacaaaagaggtcgatctttacacgagggattttgcacctgggattgggatacccgaagatccggtgacaggggcagcaaacggagcattggctggctatctttatttggaaggtatcatttctcagcaagaaaccactctcctgcacattgcccaaggggatgccatcggcagacctggcatccttcgtatcacggtcattccgaatgaatcaaagcctgtgatcaaagtggcaggcgcggcggttatcactattcgaggcgtgttgaccttataagccatcagcttgaatgggtgaggtgacatcctgttcaagctgattctacttgaaatgatctttgaccacttcgatccatcttatagccgatggagatgccgctttgaatgatttgaacgccaagttgatctcacgatatacgcttttctcaagtggaatcactttcgtatgagacatctgctccggcaaaattaacgtcggaataatggtcactccaagtccctcttgaaccatagaaatgagcgtattgttgtctcctatttcaaacaaaacatgaggcttcacgcctctttcttttaataatttcttaatgagcaggtcacagcccgcttttggcataatgaatgcttcatcatggaacgagtcaacttctatcactttcttcgtattgaagcgatgatcctcttgcatgagcaccaccaattcatcttggaaaagtggaatggtttcgaactctctcgatggctgcgttaaaaaaccaacatcaatcgtaccagatgcaatccattcctcaatctcctcataaccaccttcatataactctacttggatattgggatacactttggtaaaacggtgaatcagctgcggaagcatttttgaagaaaaactagaaaacgttccgatcttgatatttcccacttccatcccttgaatcaacgccgcctcctgctcaagcaatgacgcatgatgaatgatttgccgaagatgcggcatcacccgctcacctgcatccgttaacgaaagcccgtttcgattccgccgaagcagcactacccctaattctgactcaagcttcgcaatattatgactgactccagactgcgttagtcctagcttctccccggcttttgtaaaactgccgcactcgacgactgttagaaatactttgtattggaatgtgatcagtgtgctcacctcacttatgaattcatcgttgtcgacgacgaagacctagacgctgcttcatccgccttcacacaatcaatcgcaacaaccaatgcaatcatcacaggctccatctcttctttcaaaatatcaaccttatagctgtcaccccaagtaaaccattccttcttcacctggccgatcacttcgccattctgcagcacctggaaattcatatcccaccagttaccttgcacttctatacccgctgcatcaattgaatattttgctttaaagaacgtaaactcttttttgattgtcaatacctcttgaccaccaacttctactaaaaacttcggcaaaaagctaaacattttcttcgtaattacagcaatttcttctcgttctgtattcagaatggtaaacgtcttcggtaccttcataaaactgccttcgaccacatacacatcgttctcctgctgatcctttactgtaaacctgccgcttagactaaatactttctgcttcatgtatagttgcttcatacgtacctccgattaaattcaaacttttatcagtcatttatccattctttatttacatctaattataccaaaaaatagaatgatcaaataacatgtcgaaactcatgcaagttataatggaaatataaacaaaattgagaggagacctcatgaaaaaaatagcgttttttgactggaccattcaattacaagcagacttaacggcaataacagatcatcatgaaaagaagatggtcattttagaaccatccattgaattaaacggtgtgatctggatagatgaaaacaacgagctacaaatcaaacctacttgggattgtgtcattacaatcgatccaaccaacaaaactctaacaatccggcaaacagaagaagtattcggagaagtgtacgaatgaaaaaagcaggaggaactatgaagaaaatcactttttatgattggacagttcactatcctgaacatttaacagctgtcaaagatgatacagaaaagaaaatggtctttctagaacagactgttgaatttaaagggattatccgggattgtgtcattatgattaatgctaaaaacatgtctgttacagttcgtgattcagaagatgttgtaggcttgccatagacatttaaaagtctcatttgacacatcgcaaatgagacttttcttcactaactacttctttggaaaaaccgtcgtaaaagtcgttccttcttcattgctttctacctcaatagaagcatcgtgataagagagaacttcttgtacaatcgataatcccagacccattccatctttatttcgggcttgatctaccctgtagaatcgttcaaatattttttccaatgtctctttttctattccaatccccgtatctctgatcttcacgaccgcttttgattcattttcttcacaatgaatactgatctctccgtactctttgttgtatttaatcgcattgccaattaagttctcccatacgttgatcagcaatgtacggtcagcatatacagtgacaggctgtaaatcgattttaatttctaagcccttctcttctatccgccatagcattgaatgaaccacttgatgtagctgatcatcgatcctgactagttgtttattcgttggatatgtcccttgatcaattgaggtaagaatgagaagttgtttcgttaagtttgataatcgtttcgcttctgtttgaataatgtgattgtattttttcccttctcttgacgaaagctccccatccagtaattcagaatacccccggatattgagcagcggcgattggaaatcgtgcgagacgttattcacgaatttctttctcgcttgatctgtattctctagcttctgctgcatcatccgaaagctatcggcaagctgcccaatttcatctttgcgattaatcattaatgggtactggaagttatggttggtcatctcttgcgtggcgctcgtcaattctgaaagggattgggtgacctttcgagacatcaataaaatgccaatgatgctgctaataaatacggcgaatataaacccaaatataatcaaatgaaattctgtgaaaaggctaatattattcggacgtaaaaataatccccattcttccccttcaatttctattttcgttcccactgtattttctatatcatttgcgaaatgactcatgattaaatatgaatttttaaaggatttgatcccattgtacgcttttccgccttcaaataaggcgtgcatttggtcattccattgtgtcgttttaaagggttccccaaacatccgcatttctccatcttctttaaccaatgcaatttgataccctagatcgctcatggtttgcagaaaatcagaagatgcctgtagtgtgatttcgtgttctttgatttgtttcgctaactgctccgcaatcactaaataacgatcatttaattgctcttttacaaaggcattgtaaatcagattcgaacaaataaacccaacaaagatgctgatacaaacaatcaaacacgtatataacataaaccgttgttgtagtctcattcttttacctctagttgatagccaaaaccacgaattgtcacaatttcaacattcgctttagctctttttaatctctcacgaatgcgattaatgtgagtgtttaatgtgaattcgggttgttctaacgtatccccccaaatgtcatcaattaaatcccagcggctcacattgcggtttgcccgctgcagtagataatggagaatttctaattcccgcatgggccaaatatattgctgattctcaatcgttaattcccaacggttcgtatcaatctgaatattccccgcagttgtcaaagcttctatggatttacgatatcggcgtaaaatggcatttacacggaatagcagttctttcgtttcaaatggtttgacgatataatcatcaatcccttgttcaaatccttgctgcttatcttcaatttgccctttcgctgtcagcataatgacgggcagttcatattgtttgatcacaatgctagccagctgaaagccatccattccaggcatcatcacatcaataatcatgagatcaaatgactgatgttgcaaaaaagcaagcgctgcctcagcattgcttgcttttgtcacctgatatcctgcctgctctagatggatggacactaattgcaaaatggcttcatcatcatccacgaccaatacatgcaattatccttcctcctttatcgccttagctttgtctttttcaaagaataatatgagcgacggcagcaacattcctcgaactaagaatgtatcgatgataatcccaatagcgacaataaatccaaagataaataagtcggtaatgggcatggtcattaatgcggcaaacgtcgcggcaagaatgattcccgctgaagaaatgacccctcctgtgtttcgtatcgccacttctaatgcaactttgacgtgtaacgttttacgttcttctaagaaacggctcacaaggatgatattatagtcaattcctaaagccactaaaaagataaaggcatacacaggggcacgagtggaaatggcatcatagccaaataacacatcaactaagaaaatgcctaaccctaaagcagatacataggagattaaaatcgtcgccatcatataaatcgacattttgatcgagcgtgtcagaacgagtaacaagagaagaatgagtaacgtttccagtaaaacaatcttttgaatatctgattgattcacttgttgttcatccactaatttagccgttgtgcccgcaaaagaaagctgaacctcttgaccatctgataaacgatacgtggattgatctgtacggaattcttttaaaaattcaatggcctctatactgtatggattcaccttcaatgatatcgtcattttgccatgctctccatctttggtaactcccgaaggacgagccgaccctatttggtcattttctgagaaatgagaagagatttcttgtaaatgttcctgagataggttttgaccggtcactagcaccgttgtctgggctagatctcctttattaaattgatcctcgacgatttcaaatgcgacacgagaaggtaaatccttcgggaaatttttcactgagttaaattcataatgtaaattgaaaacattcgcccctgtcacaagtaaaaacagtaagacagcacctccaatcaatcctggttttcggacaacaaactttgcaataggcccccaaatgccatgtttcacttctctcgcttcaccatatttgggcactttcggccaaaatgctttacggccaaataacgcaaataatgctgggatcagtgtgacagaagccatcataatgatcaccatcgcagcaccgaagattggagcaaagttttgataatcacggaaatctgccacaaataaaatgatcattgccgcgaatactgtaccgcctgcaaataatacgggtttggctgttgaacgcatcgccactttcatcgcttcaaattgattttcatgatgttgtaactcctcacgataacgtgagaaaacaaacaatgaataatcaatcacagcagcaaataacaaaatgctcataatcgaagtggtcgagttattgatttcaagtccaccgacgccaagtaaagccacgacttgattcaccacttgatagacaatcaccgttgcaaataatgggatgatcgctaataacggggaacgataaatggcaattaataaaaccaatatgatcgcaactgtggcgaataacagcttcaagtcggcagattcaaacagcttcaccgtatcccctgctataccagctgggccggtaatataaaaatcagcatctagccccttcgctatgtttgtaccgacttctgttgtctcatcattaatctttgcataatcagcattgcctaatccggctttcaaattcattggcacaatcatggtcgattgatcttctgataaaaatgtggataacgcttgaggaggcaatgcggacacatcgacaatttcttcaatcccctgaatttttgcctctttgattccttttatgattgtttttacatcttgaatagctagctttccattaggatgatggaacacatataatcccggtgtccctttgtcactcgggaaatactgatctaacttcttttgggtcacgatggactgagcatcactaggtaacgattgaaaattgctcactttatgatcgcccaatttaggaccagcactcagccctatcatgaaaacaagccaaatgataacagtcagccaagctcctttttttgtagacattttatcaataaatgatctaaatacattcatccattgttctcctccttttcttaccggttcgagtatatcgctcgtatataaacttgatataaactcggggaaaaggacgagtcatgaaaataaaaaaagcagaggtttatccctctgctaatccttcataaccatttacaaaataaacgatcgtctccaactcatcttctttcagttctctgttcacatgtgcttgatattcattcacgattctctgtcgatctccaccataaagatcagtgtatttcgccatcatccgaagcttgtctctttcctgacgaaactcctcttttgtccacggtctttgatgtgaaggaatatacgtatctgcatcaaaagtatctaactcatctaaaagacacaagatttctttcaccgtataatgtactttttcagcatacattttcggataaatgcaatcagcaagaaacaggattttttcctctttcacatacacgatcactgaatctgccgcatgatcgcccccaacatgttgcacgacacaagtaaccccgccaagatcaatttccatccgctggtcaaacgtcacatccggtaaaaccacctgaatttctcgatgatccttatattcttccttaatggccttcgcgcaaaactcaatctccgttccttccctcacacgctcatcaatcgcctcatctgaccacgaaaacggaagaagcttctccatttcttttctggttttttcagaagcaattgaaaccgtatcaggcagcgcaggcagaccaaaaatatgatcccaatgccaatgcgtgaggacaacgagatcgggcttggcgttctcttgttttaaggtttctttgataaagtatttggcatgatcttctgagtttccagcatcgatcattaatgttttgttattgcctacgaccatgcctagaatggggcggtcggtaagtgatactggtgtgatgtacctaaaactctgacctatttttttaattgagtgcaaaggtgcttcctactttctgtcattatattttaaattgaatcacgttttcccatcgttccgctgtttatgatgcggttgtacttcaatataatatatgcgatttattaagtatatcgaatttcattactcgaagtagcacgtgaagccaatattgtgacaatgatcgcgattgcaacgcccaaagcccctacccaagtaacggaagatagagaaactctctctacaaagatacctccaatagctgcacctgcagccatcgccaattgcatcattgattgattgagacctaatagtatacctgatgactctggctccattgtagctaaatgatattgttgagtcgggccagaagaccatgcagcaaatgaccataatattaaaatgagcaatactccaacataagaatgcgtaactagtgagagcaatatgagcatgatgacatgtaatgtcattccactaatcagagtaaaattcacaccccatcgatcggtactaaatccaccaaactttgacccaactagactagcaatcccgaatatgagaagaactccactcagcaatttgctgcttacacctgatatgtttaaaaggtaaggggatagataggtataggcaattgaataaccaccgagccagaaaaaggtgatggctaatcccaacacaacttttggttttttaaaaagagcgagttgttgaattaaaggtacaggtttatccccttgaatttttggaatcgtaagagaaattatagccatagctaataatccgagtaaggctattcctccaaatacagctttccaaccaaagaaatcactagtcattctgcccagtgggactccaatgatcaatgatgctgtaaatcccattactactgtagcaatagcggtaccttgcttaccttttggtgcaattttttcagctattgttaatgcagtaactacgaccatccccgctccaagagccataataattcttgacacaataaataattgatacccagggaggacgaatgcaagaatattacctagaataaaaacgctaagtgaaaataacattaacttgcgcttattcattcccgatgttaaagccattaatactggggtgaagatggcatacacaagagaaaaaatcgtaattaactggccagctgcagctatcgtaatccctaatgattcagaaatattatccaaaataccagagatgatatactctgatgtaccaactaaaaaacttaccatagctaaaatgtaaatctttacagtgtttgacaatgtagatcactccttatatataatacatctacatatctagaattgttaatatgtatggacgaaaaaacatattacgataagtcgatgtgtatttaataaatgaaactgaattctgatgtatgaattcagttcatttattaaatatttttttctagaatcttagcaattttttttatggcattttcatctcttttataatacgtgtatttacctatacgctctgtcgtaattaatccagctcgtagtaaaattgaaaggtattgagatgctgttgattgcgtcattttcaatttatctgttatttgactaacacatacccctgtagtattcatatcaatcccttcatgaggtgtaaaatgacgatcaggttcctttagccattgtaaaatttgcaatctggattcattggataaggctttaaaaacttctattggctccatacaaaccattatatcgataaataacgatatgtcaacatgtattgtttgagatcccttacaactttctattttccttcttcctatggtacggcaccgtgatgcctttaaatgaggtttttaaaatattattttatgttggaatttctctagaactacatttaaattagaaattgcccatcactcttctggtgcagttgttattggtggagttaccattgcagctggttcttggctctataataagattagttattatttcagtaagaaaaatgctgatgctgcagctaaaaaaatcagagggtaaagttgatttaaaaaagtttaaagacaaacatggaaaaacgccagccccaaaaacaagcggtacgttcaaaaatggtaaatggataataacaaaagatgtagcgaatcatatagattacaatggaaacaaaaaaccttggaaaatcggcactcctacacgaaaagcatcactagataagtatggtaatgttatcagtgaataaaaggaggaactatgaagaaaaccactttttatgattggacagttcactatcctgaacatttaactgcagtaaaagacgatacagaaaagaaaatggtctttctagaacagactgttgaatttaaaggaattatccgtattgatgagaatgatgaacagcaaattaaaccgacatgggattgtgtcattatgattaatgctaaaaatatgtctgtcacagttcgtgatgcagaggatgttgtaggttttccgtagaaattaataagtctcatttgagggaaatagctcaaatgagacttttttagtttagttaccttaccatttcggcatacaccttcggataaatgcaatcaccaagaaacaggattttttcttctttcacatacacgatcactgaatcagcagcatgatcgcctccaacatgttgcacgacacaagtaacctcgccaagatcaatctctatccgctggtcaaacgtcacatccggtaaaaccacctgaatatctcgatgattctttactcttcttttatcgcattcgcgcaaaactcaatctccgttccttccctcacccgctcatcaatcgcctcatctgaccaagaaaacggcagaagcttctccatttcctttcttgtctttgcagaagcaattgaaaccgtatcagacagcgcaggcagaccaaaaatatgatcccaatgccaatgcgtgaggacaacgagatcgggcttggcgttcttgtgttttaaagttttttggataaaatagttcgcatgatcttccgagttgctggcatcgatcattaatgttttgttattgcctgcgaccatgcctagaatggggcggtcggtgtgtgatactggtgtgatgtaggagaaggtttggcctatttttttattgtgtgcatggtgtgcctgctttctataattatgatgaaccgttctctattctcattgaaatgataggattctacacctatttatgcatgaataattttaatgggaaaattaaaaaatatacttaaaagttctctataatgttattaattaatgagacaaaataactcttcttcttcagtatataaaaaatcgtgatccaaatttgcataacagcagtttaagatcacgataaaaaatttccacaacttttattctctcttataatattactaaaacgaaattataaagaatattatctaaaacaggatatttgtatgattacttatcttgacaaaaattactgtcagataattcgataagttttttatttgcatatttttcaactaaattaatacagttatttttgatgaattgctctttatattcctcaacttgctcttcttttgaaccatataaatcttcatcattatcaatttctatattatgagattcaaattttttattttcatataagtggaaatggaaaaacacatgtgcattatctaccatatgttcaacaaatgacgaaatatcatctattaattcctcatattcttcgtcttctaatatttcattcaatttaacgttactatgaacatctatagatatataattatctcttgaaattaactcttcctcggtcgccagttgattatcctcaattgtagcttttctattcatgtctgttatagaaaagtaacaatatgcattataattaagtaatcttacttcccatatctcagtatcagtcaatctgtaaagtctattaaatctatacatacaattcacccctataatttattattttttattgcaatcaatcttaaaatttttgacaggtataaactaaaagaataaaaaatcactgagttaataataacatataaaaaattcatccataacatattaaaatctatataagaattgtttaataaattatatatcataaccttactgtttgaaaaaggcacaaaaatactgccagagggaaatgcaaatatcaggtaaaataatgcaatctgggcaacagtaataattatttttttaacacccgaaaccacacctattaatactacaagcaatccaattccggagacagagaacattcctagaaatgagataacaaatataacaaaatattggtaaaagctaatgttaaaagaacttcctaatgctatgtctatcaatataataaacaacacagaaaaaatcaaatttagaaaattattaataattattcttgttgtaataatatgttcaaaggaggactttaaataacttaacgtgtatattctattttctttaatctcttgattaatttgattacccggaaaagtgaaactacttaatagtaacctaagaaagaaaactaatgatataactattgttaaaaaatcatgatacatctctaatttatttataaaagaattaactgtgaatattaaaattaacaccataaatacgattgatattaaagtgaactttatattttttatataattaaaatatgatcttttaagttcagcagttaacaaattcatctttgtatatcctccatattgaaattatggaaattagaacgttggataaaattttcttcatgagttgttattataaatgttttatctaactcctcaaacatattaaaaaatttagatacactctctttatcaaagcctaacgttggctcgtccataagtataatctttcggtccaacaatatctgaaatattattatgagtttttgtctagtaccttttgataataaactgactgttttatttttgtcttcttccaccttaaagtaatctaagaaatctataaattttttgtgtttttctaatatttctttctctttgtttatctttaagtaatagtttaaattctgttctatagacgcctcactgtataggaaatttggtgattcaataaaggaaatattatttttaacatactcagtaaaacgcttctgatcttttagtttaaatctattaaaatcaacttttaaatcatcggaaaattgaatttctccacttttaggtataatatggcctgcaattacttttaataaattagtctttccagatgcattttttccttttataatatttagcttgttttcagaaaaattcacgttatttatagatagtgaagatttaaatctataacaaatgttattcaattctatattagacaatctagcttttctctccttgcctgtatggtgaaataattttatcatacatttattttaaaaggtagatgcccgtttaggcaaatttattaaaactacggggcgtacacatagccactctttatcaagttgtcacccattttcatggacatgattataccaccagctaccttatttatatttggttttacaacgttttatatcacattcaatacgattgaatccaacatacgactttcctaaaccaaaaatgtataaaatgaataaaaaaatgacctttcacatatccctacatattagccatgatcagtcgtactgactttaatttcttatatttcttttttaacttataagaacagatgctttttcaccatgtctttctcaatcaacattattttcaagctttctctctcaaaatttaatgacatgctatgctcatcaactttacgttaaagttataactcttattatataaaaaagcttgtagatcttatctacaagcttaaataatggtcaaaataattccactgttcttttaatattagttatcctatactgccattgctcttaagaaaaacgcccaagctgctacatcatctcctgggaaaaagaaagttgctgtcgcaagaaatactgctagcgctcctaccgacactagcgcccacttaggaatcttagatatccaagattttgtttgagggttttctttttttattaggccttgcacatatttattatttgacacatgttgttttacctttttaggtaagctatcaaaattcttataactattattcttcttatcacatggtcccatagtatctaaccttagacaatagacatttttaccttttttcatgaaatgaatatgatggtatggcttagcattgtctggtgtatcaactcgataactccagcctccacccacattataggttttacctgctcctaatacactttgcattggtaaaagactaatgaacataacccccaccaataatgctataagtacttttttcactacattatcctcctctcataatattctatataataacacattttgctaatgattctatatttcttataaattattaacaaagaaaattgaaaactatactgacttaattcttatatttaatttaaattagaccatcaaaaaatctgcaatattatttttcatgtcatttaatacaatacagagtgtacaagtgaaaacttaaagttgttgcttgtattattttttatcccactggcagcttgaaagtgacagtttagttcttaaattataaaaaatctttacattataacaattgttaatttaagactcaccgcttgtatctaatgtggagggtttttatgtttacaattaagtataaatgtttatcactgtctttatcatccaataatctcttaaataatttatacgcttcctgttgcgaacggatactctcttctttcataaagaatactaaactctctaaccaaccttgcaaatagttttccacttattttctcttcttaggcaaaaaaagaggatgcctctcgcctaattgacgctagaacatccttttctaaactcataactataatatatatgctctctcattacatttatcagttaattttcggactgccggagtatacatcaccatctgtattgtatgtaagtgtaaacaccatatctgataaccatttcttaaaagagtcgttatcattgtactgcttaaacacttccatattgtcagacataagattaatgacagctcgatttaaggctttttgactctcaatttttgcattttgtttatcagagtttttcatcgcattttgataatctttatcttttgcgacaatctccgggatagcagcaatatgtttcttaacctgatcttcgtccctccaaggaatatttccaaagaggtcatggaaggtttcaagaatattgctcagtaaatctaactctacttctgatttcccaccgattgccgatgtaggtactggtgcaatttcatactcttccttatcctctagtacaatggacattttagcttgtgcttccgccctgtaactatctaagtcaatcgcttcgaggataccaattgataggtcttcttcttttggcgcaggtagctttggtatcaagaagtttaggaagattgaaagtctttcccactcggggtttccataaggcaagatggatgccaagaatccgtacgtccgaacaaatgctttcgccttgctcttgaattcaatttgaccatcttcatccaaatcatcttcataatgctttgcacagacatcaagaatcgggtctaacttatcacgttccgctcctttaaggtacagctcgactaggttttcaatatgtgtatctgtgaaaacatgatatcgtctgatgtcactttctaagtcattcaacttatccgggtcagtctcttctgaaagaacggttgttttataatacttggaaaaggcatcttgaatcgtaattgtttcatttgcaaagtcaagtacgaacgtatcatgtttctgtgggtgagctcgattcaaacgagaaagggtttgaactgctttaatgtctgtcaacaccttatcaacatacatcgtatgaagaagcggctcatcgtaacctgtttggaatttatttgccacaacaaggagacggtatgggtcctttttgagttttttctcaatctcattacttgggaacccgttaactgagctctccgttacctttttcccaccgtactcgtgctcacctgaaaaggcaacaatcggtttaaactgacttttacgtttttccaaatatgcagatattgaatagtagtactggatagctcgttcaatgctgctagttacaaccatagcacgagcatgaccgccaattttcccttttgcaatcacttggtcatgaaaatggtctaccataatttcagactttagttcgattgctttttcattggactcaacgtactttctcagctttttttgagctttctttttgtcaaatttcgggtcatcttctactatcttggcaatcttgtagtaactcttaattggcgtatagtctttcaatacgtccaaaatgaagccttcctgaatggcttgtttcatcgtatagacatggaacggtcgatgtttaatctttccgtcctttgaataaggaataccaaacatttcaagcgttttattcttcggggttgctgtgaatgcaaagtaactcgcattattaagcatttttctcccctctagaatctttaatattttatcttctgtcgtttcatttttcgcatcttcatattggttagaaagtgccatattcattttggccgacatgtttccactttgactagaatgagcttcatcaatgatgatagcaaacttgttttttcggtgttcgtttccgatgtcatcaagaatgtacgggaatttatgaacaatggtaatgataattttcttaccgtcttgaagtagtttccttaagtctcctgagttttctgcatgccccaccatattcgatacctgcataaaccctttaatggtattcttaatctgcttatcgaggttaattcggtcagtgacaacgataactgaatcaaaaaaattcttaccgtcttttgacaatgaaactaattgatgagcaagccaagcaattgaatttgattttccacttcctgcactatgttggataagatatttttgaccgacacccttctcactgacatcagctaagatagatttcacaccagacaactgatgataccgagggaagatttgggtacgctttacctttttagtttcttggtctttctcctcaacaatttgtgcatagttctcaatgatattggcaagttcacttttcataaaaatttgtttccaaagatagtccgtcttaattccatcaggattaggaggattcccagctccatttttatatcctttgttaaaaggtaggaaccatgatttcttaccatcaagtttcgtacacatgcggacttcattgtcatcaactgcaaaatgaaccataaatcgtccaaattgaaagagtaattcacgagggtcacggtctatcttatactgatagaccgcatcctcaacattctgcttcgttaattgattcttaagttcacaagtaataattggaagaccattaagaaaaatgacaaaatcaagagcaagtttcatgttatctctcgaatacatcaactgtctcgttatactgaatatattctttgcatacagagatttggctgcctcattagcttcagaaggggtcaggtaaaataaatcgagtgtaactggatagattttcagtccgtttcttaaaactttaattacaccatttttcgtaatttccccctgcaagcgattcaacaactttgctttgttgctttcacttttataaacacccaacatctccaacttttccttttgagtattttctaagaatcgaaagaaacgtgtctcatctattgcatagtctttattatagtcactgttttgtccttgctcatattcattttgattcacaagatggttcacaatcaatgtctctagtcctgattctctggtgttggttaccattaaacctcacactccttgccctctaagacttcctctagttcaattgtatcttcctctgtgtcttcgatgttaagatagttttctttgctataatcaacttccatattttgcacattgattttaccagtaacaacatttgatatgagactagtacggtattctaaaattaagtcaatctgcttttgggtaacagttatactattatcaattttttcaatttgacaataaatatgttcgattatttttgattgctcattggtatctggaacaccaatagaaaagttagaaatgaaatcagaaggtacacgcttttgaccagctgcacctgtcattacctctgctccaagctttctaaaataactagttcttgtgataagatataaatattttggcaacattttctcattagctcttagaacaacgagctcagtagtaccaaatcctatctgtgtttctaaattatctaagcaagcacctttaccattttcaaagcatggtgtaatcttagctaccactacatcatttttctcaaaataagtgaatccttctttcaccgaatgaataggtcttctttcagtattgtcaatatcaccatagttggatattttatccattggtaaaaatactacttcatctcctagcgaatattgcttaaacttctcgctctttgaaggacttattttagcgaatctttttatcttgttacattcccaatgctcaggaatatttcctaaccatttgatatcactatatttcatattaaaatctggttttaatccttttgtcatcgcttcatcaattacggcttgcttttgctctttcagaacagttattagctttttctttgctttaatgaacttattaattttcagaagctgattgtcgagatatttaacaattttcatttgctcttccagtggtggtattggtagcataatttccataaaatcattaacatctatgtttttgccttgtcttatgcctgtaacattcctttgaagctctccaataaaatcatggctcttaaatagatacttgtaataatctctactctgatttgttcgttcttctaaaatattgtaagcagggcttactatccctctatattttgagtattcaagtccaccttgaaaagagcggagactaataacaaagttaccttccttgacgagtttaaaagtttcaaggttcccagtcggcataactactcttgtttttaacatcgaccgaggaattactccatgactttgagttgcagataacaattcttcatgagggtaattttttgcagaagtttccaagaataatcgttttgatttcgcttccctccaatgcatcgggattttttttaaccatgattgttttgcctctctatattcttcatactgtttaatatttttgttcaatcgccttccccccttaagatgtcctgaagaagaccctcagtttgtgcctcaagcttcttaatatctgcagcaatatcatcaagagtacgtaattgcacaggtttataaaaatatttagtaaagctgatttcgtaccctatttgcgttttactttcatctatccatgcgtctgttgcgaatgataatacttcatccttaaaaaattgctcaattccaccttcatgcaacagtggaatttgttctgtgtctcttaaattactatctggctcatactctacaacacataattctccttcaattattgaattgaataatcccgctaaagggtttacttcaactttcccatgtttgtaaactttttttataactttatcggctttctcatcgatttttgccaaattatttttaaccaaattcactcgcctagccggaagtttctctcctaaatcttttgcgatctcatttagttcggtaataaaatcattaaaatttagtacagtagagtaattgtatttttccgctgctttttcaatgattgctgaaagttggacatccttttgttgaagacataattctgcaaactccattaaattctcttccgttaagtccactcttaaccgtaatggtcgttctaccgttatcttgtgataaccaaactctctgttatcaaaaatcttcgagttttctgtttccttgaaaacaataagcatgtccgagatttgcttcctcaactcaggcgttaactcacaatttttattaccaagatttttgcgaagtggactttttaaactagttgcatcaataagttgtactttaccacgacgatgaggtgcttttctgtttgtaactacccaaataaacgttgcaattccagtgttataaaacatattttctggcagcgcaattattgcttctagccaatcgttctcgatgatgtatcttcttaaattactttccccttgcccagcatctccggtaaatagagaagaaccattgtggacttcaacaatacgacttccgagttctgtatcgtgtttcattttgcttaacttgtttgcaaggaataacatttggccatcacttgaacgaggaatcatcttaaaatctgtttctccattgtgttttacgataaagcgcgggtctgaaatatctgattttccgcccaaacgctccaagtctgttttccaactcttcccataaggaggatttgagagcataaagtcaaaatttaatgttggatatccatcgtttgataatgtagaaccgaaggctacgttatcatcttgaagagattctcctttaataagtaaatctgccttagtaatggcatatgtttctggatttatttcctgtccatacaaatatgttttgatttcttttccgtgttcctttgctaactcgtgtaagcgttcgtcagcaattgtcaacattccacctgttccacatgcaccgtcatatacaaggtacggagcatttttaattttatctgcaattggtaagaacgtgatgtctgccatcagttctactacatcacgaggggtaaagtgctctccagcttcctcattattctcttcattaaagcgacgaataagctcctcaaagatgacacccattgtatggttatcaagtccaggaatcttaacatcaccactatcatctaacactgattttggacttagattaatagttggactaacaaacttctcaatcacagcacccaagatatccgcttcaatcatggtatctatctgattacgaaacttaaacttttcaaggatttcttgtacgttcggagaaaaaccatctaaataggcaataaagtcaactttcagttgttgctgcttcgcacgtgattttaggtctttcagagtgaaaggtgatgtattacaaaaggattgtcctgctacgttacataaagcatccgtttggttgataacacctgcttcatctaaattttttttcatttgcaaaactgcatcttttgttggttctagaacagcatccaaacgacgaataacggtcatcggcaagatgacatctcgatatttcccacgtacatatacatcacgaaggcaatcatcagcgatgccccatataaaactaacgatttgattatatgtttgattattcaatttacttcccccaataaaggtatttaaaagtacaattttatcatattaatagagtgtgattgatattttacatttgtaaaattataggaatatattctcctgttttcagcagattctcattccaacatttcttcatccagaaatatattcgattgtggcattaaaagcaatattatagattttccttgctcttttaggaccaatcccataggccttttgtaattcttcttcttttgcacttaatatatcttgtaatgctgtaaagccaacagtttttaatgtagcacactgaaatggtgttatgtccagtttatcaataggttcctgcaatagactttctagaatatgtttaatatcagcatcaatttcaactggtttaagctcatctatattttcatatgatggcgaatttataccatactctgaatataattttattgataaatttgtcactatttccttatatctatttataggtgtatttttcgtttctgaagctaatacaactccaaaattaacttgatatctatcaaatacttctgttctcacttttgtgccctctgtgtgaagtgaaattatccctgaatattctaaaattcttatcgattgtttcacaactgctggcgcatcccgatgaatagtaaagaaaattgtttgctggtacttatcttcacttacccttttatcattcttgtttaatgtctcctgtaatactttgttttctacaaaccatctaccccagtcaatcaacttcttatgacctatgtatatatcacttagcttggtatgttcattccatatattagttctataaaaattcttaattgttgtatttacattcccagtctttagactttttaaatcctcacttgccataaacaaactctttaacaacaatcttgggtttcctgatgcagcatatattaaagcattaaaattttcaccattcttttcaaagatactatacgtatcttcacctacttgattttttacaatttccctcattttttctatataatcaagacttgttatgtctctttctaccttttttaccattgcatcgtggaacgcttgaaacgtaccatatgatgttatacctgggtataccgctgccttacaactaataaaagggcaccttaaatctctaaacatcgtaaaaaactctctttgttgcaaagggataaaattatggcatgcttcatcaaagagtaatacaattctttttatattacatgtttcacatatatcctcaatcagagctttaaagtaatcaacatctcgtataataccaatcttttttaagtccactccaaatatttcactagccttctcagaaatatcaaagttcttattactccaagaattttctaaagcataaataaaatcgtcaagcttttgtagaatattctcctctttatctataaaaccaaagtaatttcccataattcctgtcgaagacagtacgatccccttcttttctagctttctctttaatgcaaataatatctttgagaacatccaatttctaaaatagacaatatctttatatgcatctacaaatatagccttactaaagttaacaaatactgcaagctccctaggagaattaaaatcttcgtccatttctttctctgctactctcaggagcattgttttaccggttcctctactgccttctaataataatggtgatttacttttaatataatttaggttatctctatctgttttagttgcaacaaatatatcaattaaatcctgcggactaatgtcctcagtacgaaaaataaattcatcatcaaacctcatatttgtattagtcctcctaatttatactcagtaagtgcttcttttaaacttatttttttatcatctgtaaaagaattcgcaaactcattaaatctaattgtaaataatatattaagtaacttaactatatcaataaacatcgctgcccaaagttcaattttatctttttgatagtatattttttgttcttcaattgtgtgcatatatttgtatttaccatgaacatactctgaacattctctgtataccgacttaaactgttctattaaatcctctacttgaaagtcttgccccaaaaaaagagaaaaatattttttatttaacaaaccattttcattatcttttaaagttgaccacttcatatcatagtcatttactttccacagcaagtactcataatttctatcaataaaataaataaaactcatacctaattcaagtgcacttcttaaacatatgtatgcatttctatacatgccttgagcggctatgtaaagggaagaaagaaggtcataacacacttcttttagaactacatttgaatcatagacttctagtttactcgaccataaattaagcatttctaagtaatgaagcatttctgcataaagttccccatgggtatcgactgttttaagggtattttcagtcaaagcttcagcagatttctccataactctttttatatcaagaaaatttgtcataacatacacctcactgtctaaacttgcaggtaaattttactactaagccttcttacaatccatctaaaagagtataaaacctcatctacttatgataaggctccccccgcacaatccgaaacgcccgataaatctgctccaccaacaccaacctcatcaactgatgcgggaacgtcatcttcgaaaacgacagcttctcattcgcacgctgcatcacagcatcacttaacccaagggatccgcctatgacaaaacacactttactttttccgtatgttgccagcttatctattgtatcggctaattcttcggaacttttcatttttccttcgatggcgagggcgatgacgtgggcgtctgggttgattttgcttaggatgcgttcgccttctttgtctttgatgattttcatgtcttgctcgctgagattctcgggtgctttttcgtctgccagctcaatgatctcgatttttgcgtatgcctgtaatcgttttgtgtattcggctatgccttgctttaaatatttctcttttaattttcctactgtgataattgatatattcacaggtcatccccaccttaagaacaagttattcatataagttatcaacaattgtggataaaatttgtgtattttgtgtccgatcattcgttccccactatatatattgcaggttcatcgcacaattcacaggttgtggataagctgtgtgtatgttcgatttttctgaattctggcggcgtttcgtgatcatctatgtacatgtctagtacggtttctatatgttctgcacaagcataaagtgatttgttcataagtttctaattcctccaatatgttgtttggttattcacaagtgtttcgctcattgttcaatataaccgatttattcacatgttaatagtcttttaccattttccacaccttttatccacaaaccaaataaaaaaacctccactcctgtgaaggcttccttctatcaaaacggattataaaatctcgttcctctaataaatgtaatcacaagcgacacaatgagcaccacaccaacaaacaataacgcagcataatctgctttttgaaagtcttttgccgtaaaccatgtgcgttttttatgctttccaaacccgcgcagctccatcgcattgctgatcgtctctatccgctctaagctggaaaaaatcagcggcatcacaatcgacagcgcatttttgatccgttttcccagtttttcattcttcgataaatcaatgcctctagcttgctgagaaatggcaatcgttcgaaaatcacgctgaatatctggaatatagcgaagagcaattgctaccgcatacgaaatccggtagctgaccccgattcggctgagagatgaggcgaattcacttggatttgttgtcacgataaataaaagcgctgctggcatcactgtcacgtatttgagcgtaatgtttaactgatagaaaagctgttcaagtgtgacgttgtaccagcctgcaatgtgaaacagctcatgctttgccccataaatcgcagctccttgctgaggtgcaaagatgtaaatggcgatgttattgatgacaagaaaaatcgccaagacaatcactacgaaagagatatcacgaaatcgtacgtttgatagctgaaagaacacgatactggcaactagcataaacactaatacgcctgtatcatacgtgagcatcgctgcggatgaccagaggataaagcaaatgagtttggttgcccctgtcagccggtgaattggcgacgggcggtcgatataggacagcatgtctacagccatgtcattcgttcctttctatcaacctcaatgaagcgatccacgagttcatttggatttggccagtctgctctcagcgccagttcatatagcgacgtttcctttaagctcgccttttggacaagtaactgatctgtcagcactttggctggtgtatcatctgcgattttttctccatctgaaatgacaatggttcttgttgtgtattcaagcatcaagtgcatatcatgggtgatcatcaaaatcgtgataccctgctgatttaattgctctaaaaacgtcatcatctctgtgtaatgtctaaaatcctgtccggcggttggctcatctaaaataatgatttctggttctaatacaagaattgatgcgatcgtgacgcgctttttctgtccaaagctgagagcagaaatcggccagttccgaaatgggtataaaccgcatacttttaagactcgctccacccgttccttgatgtcgtcttcttttacgcctcttaaaacgagaccaaatgcgacttcatcaaaaatcatttgttttgaaatcatttgatttgggttttgcatgacgacgccgattcgttcggagcgctctttgatggtatctcctgtgatgtcatcgccatttagatgaatggttccttttgttggcttttcgaacgcgcagagtaccttggatagtgtcgtcttgcctgccccattggctccagcgatgctgatcatttctccttttttgacggtaaaagagatgttgttcagcgtatttggtcttgtcggatagtcgaagctcagctcacgcacttctagtaaatcctgcgctgcattctgctcgactgacggctcagatgcttccatccattgctcgattttcattttttcctcatcatttaaggtgagatgctgtaaattcgcgatttgatctcctgctgcaattggaatgcctgcatatttcatggcttttacatataaaggctcacgtaaatacgccgcttctaatacatttgaagcgagcaattcatctggtgtcatgtctgctgcaatcgtgccgtcattaacgacgatgatgcggtcgacttggcggaaaagaacgtcctctaatcggtgctcgaccatcacgacggtttttttcgtttgtttttgtagtcggtcaataaggtcgatcacttctttgcctgttgcggggtcaaggcttgcgagtggttcatcaaacagcaaaatgtctacatcgttgacaagtacgcccgcaatagcgacacgttgtttttgtccgcctgacagctcgtgcacggacgatgccagcttgccgtctacctctgttaattttgccgcttcttcgacacgtgttttcatttcttcgcgtgtgacttgatcattttcaagcgtaaacgcgatatcttctccaacggtcagcccaatgaattgtccatcggggtcctgaagcaccgttccgacaagctgtgaaagggagaaaatgttctctttctctgcatttttcccgccgatgtgaagacttccttccatagaacctttataagacgcaggaactagcccattgatgcaatgggctagtgtgctttttcccgatccagacgggcctgcgatgaggactttttcgccttcatagatggtcaggttgatatctttcaatgtcggttctgcctgactgcgatattggaatccgaaatgttcgaattgaatcatcggtttcttcatttatgtgttccaccttgcttcatgatgtttctttcaatagactgccgcttttgcttctcgttttcgcataagcagcaatgatgatggttcctagtacaccgactgtgatgatgtttgagattcctgccacgatgccttgaacaaagactttgttcgcaggttctgcatagatcacaatgtcgagtactggggcaatgacaaaccagcccaatgcctgtgcgcctgcttgtacggcgttgaagagcgtgatttttttccagccaaagtcgccctcttctacttttagacggttcgaaatgaagccgatcaataacccaacaacacctgaaacaataatccagctccaccaaggaccaaatgtagtagcatctttaataagatgaccaataaatccaatcagtgcgcctgcaacaggaccaaatagcacggccattaatgcaaggaatgcatacgatgtctcaatttgtgtattcggaatcccagttggaatggagacgaagcgtcctaaaatcacaaagacggctgcgccaattccgatggcaacgacagttttcgttgaaagttgtttacctgccatgatgtttcctcctcttattcgtatataatgcgcggagctttgcgaatcgaaaggcgccagcctgtgcctgtcccgatgttataagcctttgcaaatgacccttgattgatcgccacgcctaaatggtcgagtgaattgacatatacgagtggttcgcctacctttaaatcggcaaaagatcgtccataggtcatgatatttttatacacattttttggcccgttggcaatggtaacttctattgcatccccataattgattgaaagctgttcaaatagcgtgtgatgaatgtttgtccataggtttccgaaccgcacgtctaaaatatcaattgttcctgtgattacttcttctttcgcataagcctgtacgactggaaggtgaataatttcatcaatattcgcctttggcccaacctcttcaaaagaaatcactcctgaagcaattctcgcccctgtatacgcgtaaatgtctctcccatggaatgtatgtgattttcccgacttcggcagccggttaatggtttcatctaaataacgtgcttctacaatgcctatatcctgtgcgacgtgtgtgagtgttccgttatctggggtaataatgtagtgcgagcttgtggttttgacgacaagactctttctttctgacccaacccctgggtcaacgacggatacgaataccgtctcttccggccagtatgtgacggtttggagcaggcggtaagatgcctcccaaatgtcatattgcggtatattgtgtgttaaatcaaaaaggcggatgctactgctgaccgtatttgccactccgtacatggcgctgaccgctccatcatcaatgccgaaatctgattgtaaaaccaatgcatgttcactcatgtcaatctccctttcatttgaaaaaatggatgtggtgtttcacgtggaacatttgaacatttgtatgaaaaaagtggacaataaaaaataccccatccttatctttgaatcataaggacgaggtatttgtctcgtggtaccacctttatttactgtttgctcgcgctaaacagcctctacaagtacaaagctccaatttggctcatatactgtggttttgataacgagtaccaactctcgtcgtgtcctactaatatcatggatatgttcagcacgaggctcagagaccatttttcgaatcattatttttgcttcttttcagctgccgaagctctctgtggaaaaattgatgattgtactttctctcgtcattgcctgtttaactatcttgaattaaagctatcatacatgatgttttttgataaatcaagatatttttctgaacatttttaaaaatgagttaactgttctggaagagtcttcttttttataaaattaagcaaatgttaaagagcgagatatggtgtctttcctttctagcggtataataaagatgaagggaggtacagcgtgtgtggaccatctgtatgaatgagtttaagcagctcttcaaaagcacaaaatctattttaacaattgttattattttcattttatctacttttgtttcaactctaccgtttattgctgctcatcaggacaaatgggagcaggcaaaggatccttattccattgggaatgaactggtgatgtctctatttggtttcttccttattttcttattgtctcacgatattttaagcagagaaatccatttgaaaaccattcgttttctcgtcagtaaaaccacccgtttgaacattattatcgggaaatatcttggactgatgctgttttggcttagctgtattatgacgacctacgtactgaatatggtgatttcacatcgttttctgttctctgatgcgttaaaaatcttaaccttcatcagtgtcggtatctcatgtgctttatttttgtccatgctctttccaaccccgcagaaatctatgtttgttgggatgttgttttcctttcttttcccgatcgtcagtatgatatctgttctttcttcagaacgattgattcattggttccaatatatcacgccttattattatgcgcgcttgagtgaaccgctgacctatatactcttgaatacagcattaaccgttgtattactccttggaacagcactcctatttcaaaggagggatgtctaaatgctatatacaaaagaactcacaaaaaaatacaggacaaaagtcgcaatagatcacatcacccttgatgtcaatcaaggcgatatcttcggactcattggaccgaagggttctggtaagacaacgtttttcaatatcattacggggatttcccggccaacctctgggacgtttacgatgatggatatgccttcattaaaaaaggtgagacagcatatcggtgttctgcctgaatatacggatttatatgaagggctgacggcacttgaacatattgcctacttatcaaaaatcaccggtacgcgccagaaaacgagtgattatgaagaactgctcgaatttgtcggcttggatcactatcagcaggaaaaggtcggttccttcacacccggtatgaagaaacggctcggcatggcgcaggccatcgcccatcggcccgaatttattttactcgacgagccttttgccgatattgacgcagattcgatcttgcacatccagcaggtcattgacacgttaaaacatgaagggaaaaccgtctttttaacggctgaccgcccaaggttcacaaatagtatttgtaccaaaactgcttttatttctgaaggaaaattagtgtccccccatacactccctcaagagaaaaccatcacatcctcaagcatacgtgcaaccttcaagcatgcgtggattgatgatgaggtgaagcctgttctcacgcagtacttacaaactgtgggaacagatcttgtgatcagtgatgacgagacctcattgttgattcgttcagaagctcaagttccatcgatcattcgcgctttcgtgaaatgcaaagttgatttatacagagtcacggctcaggatgccatgagctcctcataaaaaagcaccgtatgcgatccgcacggtgcttcttctttatgataaaggtttactcatatagattccggtttcttcaaatcccgtcttctcatacaatgaacgggcaatttgattgtgagcaaagacatgcagcgagagtttctgcactcctaatgactttgcctgctcctctaatgcagcaatggcctgctttgcaaagcctttccctcgataagcttcgaataagaaaaagttataaatgaatccttccttctgcgggtgattggggtcataacaaagccaaacccagccaatcgcttcctccccattcaagagattccatagctcatgatgctctgtctgcagtccttcaggaagcagccgaccaaattgttcttcggcgtttgcaagtgattcttcctttccccaagtccctgcaagtaccttttcttctgcgtaccgctgaatagccttctccatcaatacatcgtaatccgtctgtgacattggctgtaatgtaaccaatcgtatcgccccctttcctccatcatatgatgagcatgcaaaaaaaaccagtcccatcaaggaactggttatccgccgaatcggtcggtttgagaaagtttgatctctactgattttttctttccacttcggtaaaactgcacctttaccttgtcgccgactttcttttgatataaatacttacgaaggtctacgatattctgtacactcttgccatcaaaggaggtgacgacatccagttcctttagccccgcttttcctgctggagacaaaggctcgacactcatcacgacaacacctgatgtgattttagacggcagctttaacgtttcctcccagtgatagctcgcaatatctgctaaagacttcatgccaacacctagatacggacgcttcacctctccgtagcgctctaaatcctctataacagggatgacaagattcgccgggatagacagcccgatgccttctacctctgattcagcaatcttcattgaattgatgccgatcacttttccgtccatattgatcaaggcaccaccgctgttacctggattgatggcggcatctgtttgcagtacctccgcattccaatccgcctgtccgtctccattcgagtctacaggaatcgcacgttccgttcctgaaatgacaccttgtgtgacagagcctgcgaattcaagccctaatggatttccaatggcgatcactggctcaccgggcttcacatgatctgaatttccaaaggcagcggtttgcttgatcttatcacttttaacggtgagaaccgctaaatccatgagctgatcgcttccgacaaggttggcgccaattcttgtcccatcctgaagactcacttcaagctggttggcacctttgatgacgtgatggttggtcacgatataaaaggtgtcaccctttttcttataaatcacacctgacccgctgcctgcctctccgccttcttcccaaaagctcgacttttggatattaatgacgccgacaaccgtatccgacatatgagatacgacttttgtgaccgcatcattgacgttcacattgatggtctttaaaggaccctgtgctgcttgcccatctccgttctgctgccacccaaagggactgccgctctgacctgatacataggggaaaaagaatcccattaaaaaagctcctaccaatacgccgatcagaccagataggaaatatccttttctgcttcgtctcggcttccactctacatcgcgataatccactatgtttccttcctttcagtgaatagatgatgtatatagtgttggtaagaagctcttatcttaatcatccgattgtaaaaatcatacggcgcaaagcggggttgcctttttcgggtccgtatcatataaatcaaagccatccccgacaacaaagcctttcatctcaagcgtctgctggaccgccatacgggctaaatccttcatgttgttgtcttgactcaagtgagccaagtaaatgcgtgaggtggcatctccaatgacatctgtcatcgcaagagcggcatcttcatttgaaacatgtccgacatcgctcaaaattctacgcttaatactccacgggtatcggcccatttgcagcataccgacatcatgattgctctcaaatacaaatgtattggctgactgaatgatccctttcatacggtcactcacatagcctgtatccgtcattagggcaagtttgcgcccgccataatggaacacgtaaaacatgggctcagccgcatcatgtgagacgccaaaggactcaacatcgagaccgccgaaggattggacggtttccatatcaaaatggaatttctgctctgtatcaatctttccgatatgagactccatcgccttccatgttttcgcatttgcatagacaggaagcttgtactttcttgccatgacaccgagccctttaatatgatctgagtgctcgtgtgtcacaaaaatgccgtccaagtcttcaggcttgcggtcgatttgactcagcagctcgaccatttgtttgccgcttaaaccagcatccactaaaaaggcatgctcgtctgtttctaaataaaaagcgttccccgtacttccgctcgctagtacactgaactgcaagctcatgttctctcactccattgaagatttgtcatctttctctatgtgatcaagtgttgagccatcgatggcattgatcaaatattcttcttctgtctttttctttgaaccagttgatacgccctcaagctcgactcgccatacaggcaccatgacctgcgtgcttgcacccgggtattgcgtatagtagccaagttctacttttttcacggtcgtgttttggctcagcatgttttgcgtatataagtccttcacggtttcaagcgctgggacaagggtttcttttctcacttcattaatcgatatcaccatcgactgctgatacgatacgacctcatttttatcatttagatctagggtgatttttccgatggtttcggagtcatcaagcccctcttggaaaatgtatttccctttatacgtttggaaaaagacgattttccctgcctcttcatcaatactccacagcttataattcttcccatctagcaaacgctggttcaccaggtttgccgccgctgttttcatatcttttttcggcaaggccactggtttattgaaggtcatttcaagcagcgtgacaggatcatctttgtctgttttcgggaatgtgcttttcgccttttgatcagctaattcgtcgacatccttttttgtatattgcttcttttcagctgtaatgcggtagccaatcttcgcttcatctgatagattgccatatttgatcccgtctgccttcatttcttccagcgtatccgttttttcgataatcgcaaaatgatcggttgatcgtttttcaaagtattgaaaacccagaaagatatcgagaacgagaaaggctaggataaagatcgttttggtcttattccactccatgattctcgctcccctctgtcaacaaatcatgcgatagaatcacggttttgccgttgtatttcatgcaccatactggctccagccagacaaacatcgcttgatcttgatctgatgcggtggaagcagcttgataggccgggaaaatttgttcaattttctcaagatcatcatatttcgtctgcttgacgattaagtctttcaactctgtcccattcatcagtttgacctgttcactctgacttgctttgttgcctagaatatagtttggacgcttgtaattcaagatgtcatcattcgcccactgtacttcaagagaggtcatcccaaatggatgctttgtactgttgacgatcggcaggccatccataaacatattaaaggaaagctgctggttgctattgatgccaaagtattgatagtcatcggtaaagctccccgtatcattgaaatatttcacacttcgcttgatcaaatcgcccgtttggaaaacggtgctggaattgatattgcggtgctgatattggatgcggtggtctttttgattggcttcaagacgacttgtgccatctgtgtacaccgtccggtttaaattagactcctcaccgacaagactcgggtccgtaaacagagcgtccttgaatttgcttgtcttaatcgtttcgataaagaacattttcgcttcaagctgcttttgctttctcggaaggaggaagtctcgtttcgaattcgctgagaatgtatagagatcgtagcgcggcatctcgttttgagcagctgcgatactgtccatgagatttcgatagttagcggactctattgtcagctcaagcaccgtttccttgctgtatgaaaccaaataaactttcttgttggccttatcctgctgggagaacggcacaatcatccgatcaaacgagttgtattcaatggacttgttcggccatttaaacagcgcttggaaaatatcaatcggaatcgggtcattgaacacaagatccaatgtcttcccctgtcctccgtttccatagaagaaattcttaaatttctgctccgaatattgatctgacacatccgaaatctctttcacatcccaaaggctcacatcattccagaagttttgaaagagttccttttgatccactttcaaatgctccccatttgaatggatgaacatctcgcgcggcttcacgacatcaatgaggctccgcggctcgtcgcttgaaatcttcttcgtttccacgaccttagtgccggcatctgcctggtcctgcatgacgggctggaacatccaaatattccacgtaaacacaagactgatcgcaattaggattgtcaatattatggttttaaaggtctcacgcttcatcccaatcatcctcttgttcttcattgtacggaagggtaaaggtcactgttgttccttttccttcaatgctgtcagcccaaatatctccgccatgagcctgaaccatttcttttgcaatcgcaaggcctaggccggttccgccaagttttcttgttctcgccttatccactcgataaaaacgttcaaagattttatccatatccttcttaggaataccgattccttcgtctttgacgctgaataatacaaggcccttctcctcatccagatcaacggtaaacgtgatatgtccaccctctggagagtatttcatggcattggaaatgatattatcgagcacctgtgtgattttatcttgatcaatttccacatatatttcacgctgcggaagattgcggataaactcgacatgctgctcctttgtcatttcaaaacgatcaatgaccaatgagataaatctgataaaatttgtccactcacggttgaattgataatccttgctgtcgaacttagacagctgcagcaggtcgttgacaagccggatcatgcgctctgtttcattttgcgtcacactaaggaaccttggtgcaagctctttatcaacaattgcgccttcagccagcgcctcaagatagcttcgcatcgtcgtcagcggtgtgcgcagctcatgtgatacgttcgcaacgaattcacggcgttctgcatcaattttctcctgctctgtgacgtcgtaaataaccgcaattaaaccatcaatctttccgtgctctttctgaatcactgagaaattcacacgcaaaacagacagctgatcttcgcgttcaatttctagcagcatggaatcttgattttcgactaaatcctcaaaggtatgcgtgtcctcaagacccagtaaggacgtaatcggcatctctagtgctgtttcacgtgaaacatttaacagctctaatgctgggctgtttaatagaataatcgcaccgttttgattcgtggcgatgacgccatctgtcatataggcaatgacagaagaaagcttcttccgctctccctctgtcatgagctgcgcttcctccagctctctcgtcagatggttaaaggttgtcgcaagctggccaatctcgtcatgtccatactttcgaaccttcctggaaaagttccctttggcgagctcaatcgcttgcttcctcatatccgaaataggatgagtgatggttctaaagatgaaaatcccaagtagtgcggtcgtcccaagggcgatcagtgtccccgtcgccaaaatggtgttaatggttcgcatttggttaaacacgctctccatcgaagacacaacataaatcacaccgacagtttcttggttttcatttttcacggctgtcgcagaaatacgcacccgtttgtttgattctgggtcatagaatttcttttcatagtctttgcctactgcgaaaatccggctaatgatttgatctgtgattttcttgccggcaatctcctgactgccgttattcacagaggcaatcacctctctgctttcgtcaatatagctgacttcagaaatttcattagactcatctttgttattaaagtcgtttaatatcttttgagcatcctcttttaattctgccttacttttcgatgaatcttgttctaggtaatacgataacgagtagattcgctgattcaaggaattatcatatgaattaattaaggactgctctagctgcttcacaaagtacacgccaatgatctgcatggcaacgatgatcagcagcacgtaaatcaaggtcaatttaaagtgaatcgagcgaaaaaaacctactttattcataagaatcttagtcctgctctgggtttcttaaataatagccgacgcctcgtcttgtcacgatccagcttgggtggctagggttgtcttcaattttctcacgaagacggcggacggtgacgtctactgtccggacatccccaaagtaatcgtagccccatacggtttgcagcaagtgctcacgtgtcatgacttgtccgatatgtttcgctaagtaatgaagcaattcgaactcacggtgcgtcaattcaatcgtttcctcacgcttagacaccacatacgcatctggataaatgacaagtgatccaacttcaatatcatttgattcagattcttcctctgtctgcggcgtagcaatttgccttcttaaattcgctttcacacgggcaagcagctcgcgcgtgctaaatggcttcgtcacataatcatctgcgccaagctcaagaccgatgactttatcaatttcagagtcttttgccgtcagcatgataatcggcatatcatatttctttctcacttcacggcatacctcaacgccatctttgtttggcagcataatgtcgagcagaataatgtctggttggatttcttctaccatttcaagggcttcatttccgtcatatgcacaatgaacctcatagccctctttccttaagttaaactccaatatatcagcaatcggtttttcatcgtctacgacaagaatctttttttccattgtgatttcctcctgcatttttagcatctatgtcattcatttttgcatgtctcatcagacctttttcatttgagcaaaaaaggctcactgtctattataacgttttacgtggcaaagataaaaataataacggctttcttttctagcaatcgttggataagaagacgacgctcaaaaaaatgatggttttttccttttttattgaaacttttccagtcatagatcgtctatatagatgtaacgtcttcttcttatggagccgggccctacctaggtccggcttctccctttttatgccttcttttcataagaaaaacgcacctgcgattgcagatgcgtttggaagtggctcgggacggaatcgaaccgccgacacacggattttcagtccgttgctctaccaactgagctaccgagccatcatcaaaaagatgaataaatataaatggcggtccggacgggactcgaacccgcgacctcctgcgtgacaggcaggcattctaaccaactgaactaccggacctcagtaacttgcccgaaaaagcaatcgtggtgctcttccaagcaagtgaggaaaaattagcttaacgctaaagtaaatcaatgacccgtacgggattcgaacccgtgttaccgccgtgaaagggcggtgtcttaaccgcttgaccaacgggccaatacatggtgagccatgaaggactcgaaccttcgaccctctgattaaaagtcagatgctctaccaactgagctaatggctctcggtttgtgaaaagtaattctgaagaagttgtactgcgtcaaaccaatcgctttaaaaaagctggaacatcgcatcctaacaagtttcagagacctttgcaacaacgagatttataatatcatagagtaattacatatggcaatacgtttttcgacatttttttaaaaaaagtgtcggatttgaaatctcctgccaaatcccttctgcttgcaaccgccttcattttcactgcctcttttcatgacctctgcctattcaagcacatagaaacgttttagaccgcccgaaattggttatacatgaaacaagtgacattgtgattgaaaaaggaggaagcagtatgagttcattcaaattaggagataaaatgcccaatttttcactcccaaccattcagggcgaacatattgattttcacaaacatttagaggagcatcaaagctggcacctcatcgtcttctttagaggctcatggtgcccggtatgtgtagaagaattgaaagagcttgaacagcagcaatcatactttcaagacaaggatatccacttaatggcgatttcaacggatcattctgatgacttgaaggaatttgcggataaagaaggactatccttcccaatcatgtctgacaaggacctcacttccataaaagcatatgaagtccactatcatggagaagatgctccttatgaagatcacggagtacacggggaacctgcctatttcttactaaacgaaaagggccaagtcctctatcagcaaagacaaacaagtccgtttggcagaccgcatgccaacgaactgcgcaaaatcattcagtacatccgcaaaaacttaaaaggtcaatataaaagcgtgaaataagaaaaaagccctcaagacgagggctttttttatgaattccttttatgatataaccggtctgcggcaaaaaacacaagaagacccgacatgagaatgacaaaggtgacgggcggtttatcatcctggacataagagtacagcgcatgtcctcctaatgcgagaagataaaaaataaatgccgccactgctgctttatgtgcattcgcttgttctctttgcgtactttttttgaaaaacattgtaacgattcccctttatactgctttcttcatcgtcacccggcgaagtgcccgcgaacgaatatattccattggaccaattctccaaagctttagacaaaatgctgatatggcgatttgcagaagagaaataagcagccatgacaatacgataagaggggcgttgatttgtccgccaagacccaatccccagctataaaaaagaaccgagcagatgacattttgcaggatgtaacagctaagcgccattttccctacatattcgaaccaattccacatgaaccatgactctgtgtgagccaggagcttcgcaataatagcgatatagaaaagagaaaggaatggcgaaaacgcatagcgaaccacgaattccactagttcgttcggaacgaagacaagtgcattcagcggcaaccccacccatagaccgattcgaaataatcttttccgtagagactgcccgcattcatttgcataaaatacaccggctctcatcatccgcacacctaataaaaacaaaaatgtgttcattggaatgataaagatcgcttccacccggtacatgaaaaagtgttgtaatcgttcttgaacttgcgagatccatgtctctggcagctgctcttccagcgcgggttcactaccttgatcatacgatgctgtttccatttcagagagggcgaacaccatcagacaggacagaacaagcagatgaatgactccagagaagatcatgcctcttttgattcgtttgctccctcctcgtacaataaatgccacaagcagaccggtgacagcgtaactcatgagtacatcatattccatcacaagtgcaaaatggacaaagccttcaataaataagaataaaagaatccacaaatatgtacccggccaaggcgtattttttcttttcgcctgctgatatttcagctctagccctacaccaaacataatcgtgagcagcgatagcattttcccgtagacgaacatggaaacaaggctttctagaaaactgccattctcatattcatctgcaatctgatctgtcgcaaaggtatcccctgcatacgcaaaaaaccagacgttcgttcccaatgtgcctaatatggcgaaacctcttaaaatatctaataatcttattctttctttcactagaacgctccttccccctatacagttatcatattttggtaatgaccggaagcctgttctactgaaattaagaaatatttaaacaaaaaaacaccagtaaaatgtgcaattttactggtgtttgatcagtctatgattatggacggtacacgctgcggacaacgttcgtttgggaacgatctggtccgactgagaaaatggaaagtggaatacctgttaattgtgaaatacgctctaaataatgacgggcattttcaggcagttcgcttaaattcttcacgcctgtaatatcctctgtccatcctggcatttcttcgtagacaggctcacatttcgctagttcctttagacttgctgggaattcttctgtgatttctccgttcaatttataagcgacacagattttcaatgtttcaatccctgtcaatacatcaattgagttaagagatagatctgtaatcccgctcacacggcgagcatggcggacaaccacactgtcaaaccagccaacacggcgcgggcgtccagttgttgtaccgtattcacggccaacctcacggatttgatcaccaatttcatcatggagttctgtcgggaatgggccatctccaacacgtgttgtgtacgcttttgacacgccgaccacatgttgaatctttgttggtcctacaccagaaccaatcgtcactcccccagccactgggttagatgacgtaacaaatggatatgtcccttgatcgatatcaagcataacaccttgtgctccttcaaatagcacgcggcggccttcatctagtgcgtcattcaagacaacagatgtgtccacgacatattttttcacttgctggccatattcataatactcgtctaaaatatcttcaatcttgaagccttctgcgtcgtacattttctctaaaagacgatttttctcttctagattacgcgcaagcttctcttcaaatacttcacgatctaatagatctgcgacacggataccgatacgagctgctttgtccatataagctggtccgattccttttttcgtcgtaccgatcttgttagcccctttccgctcttcttctacctcgtccaattttaaatggtaaggtaaaatcacatgggctctattgctgattctgaggttatctgtactcacattccgttcgtgaagatacgcaagctcagtgaccaacgctttaggatcaaccaccattccattaccgatgacacaagttttctcttgataaaaaataccggacggaatgaggtgtagcttgtaagtcactccatcaaatttgatcgtgtgacctgcattgtttcccccttgataacgggcaatcacctctgcattttctgaaaggaaatcggtaattttccctttcccttcgtcaccccactgcgtacctactacgactactgaagacatatcgtgcacctccgttaacctttcaaaacgttatctctttcaaacacatttattttatcaatgcaaaacgaaaaagtcaacgtgaaatccgaacattaatatctcgaaatcaaattttgttcgttttaaatatgagaaaaagcgctttactcacttcttcagcgcttaaaaagggagattttgagtaaaaccaacgtttttgattgttcttactttctattgattttcaattaaatgaatcatcgagcttgccataaaatcaggtgagtacggtcgccctgtcctcagccaccattcagctgttccaacgtaagcagaaataacgaattgcttctgcatgtcgataggaacgagatgcggatcgggctttgagcctgcaaccccctctacccccaaagaaaagctttcttcaaaaaaagcacgaaccgtttcatgaatattgagctctctccctcgtttccagagaatttgatactcctcttcatgttcctgcaaatgctgataaaatcgaaaaatatatacatatgccgcatgctctttttccaaatcatcttcttgtacaggcgcaaaaatggcacatttcatcacatcaaacatctcatccatcacctgctgggcaagatcaaatttatcctcataatgttgataaaaggtcgtgcggtggatacctgccacttttgtcaaatcctgtacagaaatcttcccccattctttctcacttaataactgaaataatgcttttcttaattgctgctttgattccgttgcgcgcttatcccctctgtagcagtccgccacaagccgctctccccttcctattttcttcaacagatttcgcttttctgttggttgaatcctccaggctgatgaattaactttaatctaacacaatgaaaaaaaggaatcatctgacaacctataaggagtgatgatcatggaaacaacaaccccaagtgccgtgcaaaaaacgttattaagaggaaagaacaagcaggacccgtatcacccatttgattggtatgccaacatgcgccagacatcacctgttcattttgacgaagccagccgaacgtggagcgtattcacctatgaggaagcaaagcgtgtgacaatcgataaagataccttttcgagtcagcctcctaaaaaccaacggaagcattcactgatgaaaacaatggtgatgatggatcctcccaatcacactcgcatccgctccattgtcagcaaagcctttacccctcgagtcatgaaattgtgggagcctcgtattcaagaattaatggatgaactcatggcacaaatagaaggaaaaaaagagatagacctagtgcaagacatctcttatccacttcctgtcattgtcattgcagagcttttaggtgtgccatcagagcataaacaatcctttaaagaatggtcagatattctcgtcagcatgcctaaaagcgaaaacgaggaagatgtagctgaatggcagaaaacacgtgacaaaggagaagctgacatgatggcgttttttgcagacaccattgaaaagaaacgtcacaatctcggtgatgatttgatttccctcatcattcaagcggaggagaatggagaaaaactgtcagcggatgaactaataccattctgtaatcttcttcttttagcaggcaacgaaacaaccaccaacttgatctccaatatgattttcagcttgttagaacagccgggtgcgtatgaagcgctctcccaatcacctgaactcatcccacgtgcggtggaagaggccgtccgttttcgtgcaccagctcctgcgatcgtccgctatgtcacaaaagacacagagcttggaggtaaagtgttgaaaaagggagacaatgtgattgtgtttcttgcttccgccaaccgagatgagcgtcaattttcaaacgcacatgaatatgatatacaccgccaccctaatcctcatattggtttcgggcacggtatccatttctgtcttggcgcaccactggcacgtcttgaagcatgtacagctataaagtttttaatagaacgatatgaggcgctagagctcctctcttacgttccgatgacaagcagcagcatgtatggactgaaagagctgaaactgcgtgtcacacctcgttcataacagaaaagactcccgggcatgggagtcttttttttaaacgggggtgattccatctgtgttcatgagcacaatgcgatacccatctggatcttcaatggttgctcctccacgttcccaatatggatttgtagaggtgacttgccgtccgccaaatgagagcaatctctctttcatttgcctgaattcctcagcatctggaatatagaacacaagaagctgttctggatgcggggcgggcaggctttcttcttcttcatgcttcgtgatttctaaatgaacatgctgatgaggaagccccagcatgactccatcatatccttcatgctgatcaaacgaacctattcgtttgagtcctaagccttcttcataaaaggacacaacctcttccatgttgactgttgggcgtgcgatgcgtaattgagcggcttcgaactgttgaaatttcatcagtcatcactccttttctccttttagtatacgatttctctctctttctctcctcctcatttcgatcgtttttcaatcattctttcgatgtagattgatcaaaaaaagcccagcttcttgagctgggctttaagcaccgggcggaacacccgcatcgtcaaatcttctttccaggttgacgaatttgttatattctttgacgaacgccagtgatactgtaccaactgggccgttacgctgtttggcaatgatgatttcaataatgttcttattctctgattctttgtcatagtaatcatcacgataaaggaatgccacgatatcggcatcctgctcgatacttcctgattcacgaatatctgacatcatcgggcgtttgtcctgacgctgctctactccacgtgaaagctgagacaaagcaataactggaacttcaagctcccttgccagcgatttcaatgcccgagagatttcagacacctcttgctgacggttatcgcttgatcgtccgctcccttgaatgagctgtaagtagtcaatcagaatcatgccaagaccgttttcttgcttcaaacggcggcattttgagcgaatttcacttactctaattcctggtgtatcatcaatgaaaatcccactatttgatagcgagcccatcgccattgtcagcttgccccagtcctcttctgtcagattaccggttcttaggttctgtgcattgatattcccttctgcacaaagcatacgcatcactagctgctcagctcccatctctaaactaaagatggcgacactttcgtccgttttggtcgcaacattctgtgcgatgttcaatgcgaaagccgttttccctactgatggacgagccgcgacaatgattaagtcatttcgctggaatccagctgtcatccggtcaagctctgagaaacctgttggaatccctgtgatatcgccttttcggttatgaagctgttcaatattatcatatgtctgaacaagcacgtccttaatgttttggaaggctcctgagtttttacgctgcgccacttccataatggtcttttcagcatcactcaacagatcctctacttcatcctcacgcgtgtacccatcctgtgcaatggttgtcgccgtgcggatcagacgtcttaaaattgatttctcttctacaatttttgcatagtattcaatgtttgcggcagttgggacagagttcgcaatatcggttaaatacgaaatcccgcctacctcttctagtaaatctgtattggccagttcagaagtcaccgtaacaagatcgaccggttcccctctatcaccaagtacaagcatcgcattgtaaatcttttgatgcgacattctatagaaatcctctggaattaatacctcagaagcgagcgtgagcgcagatggttctaaaaaaacagcacctaatacggcctgctcggcttctatattttgcggcggcagccggtcatcgagaagttccgtcatgccaagcaccgtcctttcataaaaaaatacgctactcatcattttaacattttcatcaataaaaaagtgaaaaacatcgactatagtcaaaattaccatgaggatgtttcgttgaacagccaactaacgcatttcaatagaaaagactctgtaacataagttgttatagagtccttcattaccgctaatgggatttgtatctgttgccgttcacatgttattaatctatcgttttcttcactccataattttctttttgtccaatgtcatgcaaagacccgttttgataaccaattgataacaccaaatcgggaatagaatcaaacccgtttttcgctagatcaaacagctgtgctccgtaatgtgaagcggcaattcgtgcatgttctgctgtgtatggatttttcaggagatcttctttgtatatatcaaaaatattcgttcctttatccgttacaaattgaccatttacaatgcttaaatcctttaaattgtagcctgtcaccgttttgatttgattcacaagatggaactttgcaagagaatcaggcgtgaattgagtagaatcatcatttctacttttcataatatgaaaaaataattctcttgtattgttgcttgtatttaataggtcttctatttgtttggttagcgattcatctgttgatccactcaccactaatttgaaatgatttgggtcaatggtaaaagttaaatttgtgtttttaggaatggttataccgtttttagagaataaatcttgcaattgttcgttgaccttttgtcgattgaatattttcttttctacgctttcttgagtaggatcgtaccgtttttcgttacggaagatggcgtcattaaagtcatattgcccacccttattattccttgcccaactcatttccatagtgtacgcagcttctctttcagacttggttagatcacttctgaaataagaggagtatggatttctatacttattatatatgtggtcttgaggatcattgaatcttttattttgttcattaattttttgatatttctcatcaagtatcttcattcgtttatctgcttcggtcatcgtctcgtttgtgcttttaatagtcgattggtttttagaatctgtttctttatgagtgtttgaagtagctgccctgtatgacgtattaatattcattttgattctcctttttgaaaaattagtgattattaaatatatcggcaattcagttaaaatttgttagttttgatccgatatagtaattattacaaggagggttaaaatatgccaaatactatattcaaacgttttttattacctgcattattattagtgcttgttactagtttttttgcacctaattcagcagaagcagcaattacggggaataacagtcctaacacagcaagcttaatgggatattggaaatatagtcgtccagatacgacaatcttacctgaaggtgaaaatgaagcttattatcagttcacgatcaataagggtgaaagggtttatgtgcgaagctcatatgataagaattatacaggtatgaaaatagaagtgtataattcaaaacaatctatgacagggtccgaggttataaatcctgattcaattacaccatttatttttgctaatactggtgacgttacttcaacttcagaaacttattttgtaaaagtgacccgtagtacatatacagggaatatgtactttactgtttccattcaagatcgaattaaatctggaaatgggacattcaactttacgggggccgctaccaacttggggaatacttctttgaattttttaggagttgattcttctgtcattacaatggatttaactaatcatacggctattccccgaagtgcaatcgttaaatcaatttcaacaacgagtacacaatcgcctaaccaaggaaatgtcacacacaagctgatggctgatgaaaacaagatttggaacgaatccattttttcatctgcaacaagtggttcttaccgtatttctcttgaagatcaattaaaagtcgcgcaaaaatggagctttaagtacaacgcaaaggctacagcgagatctactatgagcaatgtcaaagccgatatccgttacgaatatgatgtcacagatggattctaattgaatggtgtttacagaattaaaaagtaagggtacatcccttactttttttaattgttatcattcgccactcttaaaaaagctgtacatactattgaatcagttttgagatatgagaccatctacttttcgcaaaatcctcctcaatctccctaaaaatacaagtgagtctatagacttatttttccttaaaatcatttcaagaagaaaaacccatatttattcctgtatcaaacagaagaaaatgtaaaaatcccgaggcagtcaaggtcttttgacatttctcctatttttaaatgacaaggtccgatattccctatttcaaatcatttgttagtgagttagtcctttattttctgaatattagaataaaaaaaccaagtacacaacttgatgaacatttgacttcataattgataaccattatcatttgtttgcggatagttgagaatcattttcatttggaggagccattcttcaagtactacactcatcccatagctacaagcctgcttttatcatcgtatgagagtcgaatttgaggaaggagatttgtcacatatgtccaaacgccctgaaggaatgggtactgaggattcatttttcggagaaagccgtcctttttttatacccgagacggagcaactagatatcacagcacacccatacagactttttatatttaaaccgaatactactcctccagcggctggttttccagtcatgtacgtgcttgatgggaattcactttttggcacaatggtcgaagccattcgtttacagtcaagaagacctgaaaaaacaggtgttgtacctgccatcattgttggaattggctatcagacagatgcgccctatcatccgctcaggtattatgacctcactcttaccagccctgacgcttccatcgggggcaaaagaaaagacttctccatccatacatatggcggggcctctgctttcttttcttttttagaagagactataaagccttatatcgagcaacgctttccgatcaacaagagtcgccaaacactgtttgggcattctcttggcggtctttttgtattacacacactatttgagcaccctgatgcttatcagacatatattgcaggcagtccttctatccactggaacaaaaaattatttctagaaaaagaacaccaatttaccaaccgcatacgtcaggtgcctatgaatgtcaggctgcttgtaggtgtaggtgagttagaaaaacatcatccatgtcaaatgaatgctcatgcaaagtcactagcaaatcggatgttgcctttatcctcatatggcttacatacggcctatcacgagttccctgaagaagggcatacgtccgttttaccggtgctgatgaattacgcttttcgttttgcgctctatcatgatgatcttttaacaaccacagacatgaaagaaaggtagtgaacgtatgaaacatagtggtctatctcaaaagattgcccttgtcacaggcgcagggcaaggtatcggacaagcagtcgcaaaaagactagccgatgaaggtgcgatcattgcagcagttgacgcaaatgaagatcagcttcaaagcaccgtccatcaaatgaatgatgaaggcttacgtgcctttgcctatccaggtgacattaccgatcaagcatctgttcagcacattgtcaaacaaattgaaaaacagcttggacccatttatttactagtcaatgtagcaggcattcttcgaatcagttctattgaccagcttagtgcagatgactggcaacaaaccttcgcagtcaacacacatggtgtcttttatgtttcacaagctgtctccaaatacatgatgaaaagatcagcaggggtcattgtgaccgtcagctctaacgcaggtgccattccaagaatgaatatggctgcctatgccgcttcaaaggcagcagctacttcctttacaaaaacgcttggattagagctagcagactatggaatcagatgcaatgttgtctctcctggctctaccgcaacacctatgcaatgggctttatggtctgatgaacaaggcgcagaccatgtgattaaagggtcattagagacgtataaaaccggtattcctttacaaaaaatcgctgatcctcaaaacatcgctgatgcagtcatcttctttgcatctgaacaatccagtcatattacgatgcagaatctcacgattgatggtggcgcaacactcggaatctagcatttcatcaaaaaggaggccttttcatgaaacattcattattgccgtcagaagaaaaagtacagttgattcaagactatcagccaggcgcttttttccttgcttcccctaaacgtacaatacttgcagaagggattttccagcatattgaaaccaatcagctcaatgaactctccacaagggtagcgcacgtatttgacactgccaaacaagctggtattcaatcaccaattattgctggtgctgttccgtttgatccggcgcaacccgttcgtttaaatgtgccaatccatgtacagtttagtgacccactcgaatttcatcaaggtgatgagaaatcggaagtgacatcgccatcctatgaggtgacacctgtcccttctcctgaagtctacatgaatggtgtgaacgaagggttagctaaaattgaaaaaggagagcttagcaaaatcgtcatttcccggtctctccatctcaaatcaaatcaagacattcatacgaaagcaatactcgaaaggctggctcgtcacaatacgactggctatacgtttgctgcaaatgtagctgatccgaaatctccccaaaagcgcacacttcttggggcaagtcctgagctgcttctttcaaaaacgggttcatctgtgatttccaatccactcgctggttctcggccgcgtagttcagatccagtagaagaccagcgccgtcacgatgaactccttacttcagcgaaggatttacacgagcatgcagtggttgtcgacgctgtcactaaagcgcttactccttactgtagtaagttagatgtgcctgtatcaccatccgtcatacaaacagaaacgatgtggcatttatctactgtcgtaaaaggtgaattagcagattccagtgtatcctcaattgatttagcgctgagccttcatccaacacccgcagtatgcggaacacctacagcagatgcacgtgaagcaatccaagcgattgaacccttcgatcgaggatttttcacaggaatgatcggctgggcagatgcaaatggtgatggtgattggattgtcaccattcgttgtgcagaagctgagggtcaatcccttcgcctctttgctggtgcaggagtggtcaaaggatctaaggcagaagaagagctagccgaaacatctgcaaagtttaacacgatgcttcgtgcgatgggcatccatcagctataaaaatacataggagatgacaaaaacatgtttgttcaaccacctacatggccagaagaatttgcaaaacgctaccgtgaaaacggctgttggcgtggagaaacctttggcggtatgcttcgtgaacgcgccgtatcgttaaggaataaaactgcgattacatacgctgatacgcacatgagctaccaagaacttgatgagcgcgtcagcagtcttgccgccggtttccatcagcttggaattcaaaagggcagtcgagttgtcgtgcagcttcctaacattcctgctttttttgaagtcattttcgctttatttcgaatcggtgctttacccgtcttctcactgccatctcatagaagcagcgaaatcacttattttattgagtttgccgaagcagacgcatatgtcataccagatatccatgatggctttgattatcgatcactcgcacgtcaagtgaaagaaaagcttccctcattccctcatgtcattgttgcagggaaggctgaggagttccttgacttggatgatctgcacaaggacccatcacttgatcctcaaattcatgtagaggcaagcgatattgcatttcttcagttatcaggaggcagcacaggcctttctaagctcatacctcgtacacatgatgactatatgtatagtctttggaaaagcaatgaggtgtgcgagctcacaaaagatagtgtgtatttagctacacttccagttgcgcacaactatccattaagctcgcctggagtccttgggacgttatacgcaggtggaagagtcgttcttgcacctggatcaagtcctgatgtcgtctttccactcattgaaaaagaacgggcaacaattaccgcagtcgttccgcctattgcattgatctggctagaagccgctccacatcgatcagatgacttatcgagtcttgaggtcttacaagtcggtggtgctaaattaagcgccgaggcagcaaaacgagtgatgcctgcccttgggtgtaagttacagcaagtttttggcatggcagaaggtctggtcaactataccagattggatgatcctgaacatgtcattatccatacacaaggtcgtccaatgtctgaatatgatgaagtactagtggtagatgatgaggacaagcccgtcccgaatgaagtggctggacaccttttaacaagaggaccttatacgattcgcggctactataaagccgatgaacaaaacaagaaagcatttacacccgatggcttttacagaacaggtgacatcgtgcgattaacaaaagaaggaaatgtggtagtagaaggcagagacaaggatcaaatcaatcgtggcggcgaaaaggttgccgctgaagaagttgaaaatcatttacttgcgcatcctgacattcatgatgccgccatggtgtccatgccagatccgtttcttggcgaacgctcatgtgcctttgttattgcgaaaggaaacaacaagccagcaccacacgccttaaagtcatttctaagagaacgcgggctcgctgcctataaaattcccgaccgcattgaatggatcgatgcgttcccacaaacaggtgtaggcaaagtcagcaaaaaagcattaagagaattagcttcaatccatactgccaacgtataaaaaaagaggagtgaaaaccatggcaatccctactattcctgcgtatccaatgccaagcatacaagatttacccgaaaataaagtgaactggatccctgatccgaagcgtgctgtcctgctgatacatgacatgcagcaatattttttaaatgcatttcaacaagatacatcaccgatcacagagttagtgcaacatattgaacaattacgtgatacatgcaaagaacttggcattcctgtcgtctatacagctcaacctggtgaccaagacccgaaggatcgtgccttattaacagatttttgggggcctggacttggtgatgatgaagcattgacaaaaatcattgatcagcttgctccatctgaagcagatacaatgctgacaaaatggcgttatagcgcattcaaaaaatccaactttttagatcttcttcacgaaggcggacgtgatcaactgatcattactggcgtatatgcacatattggctgtatgctaacagccgcagaagcattcatgctcgatattgaaaccttttttgtcgccgatgccgttgctgacttttcacttaagcatcacaaaatggcaatgacctatgcagctgaacgctgtgcggtgaccacaacgaccaatcaaatcattcgtcgtttaacaggacaggaagcagaagatgacctatcctttgataccatcgttcaccaagtagctgagtatctccaaatcaatccaaatgaaataccgcttgatgagaatctcgtctaccttggccttgattcaattagaatgatgagtctagcggaaaaatggagacagcaaggggcaacagtcaatttcgttgagcttgcagcaaatccaacgctcacgtcttggcggactcttctcttcccagaaaaacagccatctatcccaaatatcgattacttgtaaaggaggtatagacccttgtcgatccagtcagtcgattcattcccactaaccggtgcccaatcaggcatttggtatgcgcagcagcttgatccatctaatcctattttcaatacagctgagtatatagatattaaaggtccaattgatcccgtacactttgaagcagccattagaaagactgttatagaagcagattccttgtatatgcgcttcgttgaggatactgacggtccaaagcaatggttgatatctaagaaagagattccatttcaatatatcaatttacaaaatgaaaaacagccgtttgatgcggctaaagcatggatgaagacagaccttgcaacaccagtctctttagagaaagatgtattattccgtgaaatactttttcaacttgctgacgaccgttttatctggtatcagcgcattcatcacattgccattgatggattcgccttttcgctcattgcacgtcgtgttgctgagatctattcagccctatcgaaagggacttctgtgcctcctcaaacatttggagccttacttgacgtagtccaagaggagatcacctatcaacagtccaatcggtatgaagatgatcgagttttttggaaaaatcgctttgctgatcaacctgaaattgtcagtcttgctgagcttgccccaagaacgtcggatcattttatccgcaaaacggctagctgcgatgccgaaaaggtaagcaaaatgaaaaaaaacgctcaatttttcggtggtacgtggcatgaaatgattcttgcggcatccgctctatatatgcatcgtatgacgggtgcacatgatattgttttaggattacctgttatgatgcgccttggatcttgcgccttgcaaacacccggaatggtcatgaacctggtaccgcttcgtttaacatgcaaaccagaaatgacgctctcagcacttgttcgccaagtatctgatgaactgaaagccattcgtcctcatcaaagatatcgtcatgaagacatgcggagagactttaaactcatcggaagaaatcaacgattattcggcccgcagatcaatatcatgccatttgattatgatctcaagttcgatcagagcattggtcaagcacataatctttcagcaggacccgtagatgatatatcgatcaacatatacgaccgcgcagatgggaacggatttcaaatcgactttgatgcaaaccctgccgtttacaaagagcaaacaattgacgctcatcagcagcgttttcttcaattgctggaggaaataaccggactagagcaagatcagacaatcagtcaattcaaccttcttttgtctgaagaaaaagagaacattctcaagcactggaatgatacaaaacgagaattaccaaaagaatctttacgggaactatttgaaaaacaagtcagcaaaacaccacaagcaaaagcattacagtttgaagaaatcactttgacatacgaagagttgaatcagcgggcaaatcaattggctcattatttgaaaaagcgcagcattggaccagaacaatttgtcgcaattgctatgcctcgttccatcgatatggtcgtaagtctattagccgttatcaagacaggagccgcctatctgccactagaccctgattaccctaacgaccgtgtcgcctatatgctagaagatgccaaaccggcgtgcttgctcacagtcaaagagacagcagacggtttggagcatccgcacatcgttcaactggatgattcaattgttcatcaggagatagcagacagtccgcatctcaatccgacctggaacgaaggctccccgcatcacccggcttacatcctctacacgtcaggatcgacagggaagcctaagggtgttgttgtaacaaaacgaaatgtgatcaactttatattgtccatgcaagattcatttttattagatcaaggggaccagcttttagcggtaacgaccattgcctttgatatttccgggctagaaatgttcctcccgcttttacatggtgccgctatattattggcaaaaaaagaaacgatacaagaaccagcaaagctttcagacatgattcgttctcatcatgtcacaatcatgcaggcaacaccaacgttgtggcatgcgttagcagatgattaccctgacgtgataacaggtatgcgtgttcttgttggaggagaagcactccctgcctcccttttgcacacattacaatctcttcaatgcgacattaccaatttgtacggacctacagaaacgacgatctggtctaccatggaaaatgtcacagcacatcgagagaatagtggaccggcgattggcaaacccatttggaatacgagcgtttacattttagatgaaggactaaacccagtcccagcaggatcaatcggtgaactttatatcgcaggtgaaggagtatccagaggatatcttggacgttatgacttaacggctgaacgatttgtcgctgatccattcggcacaaaaggcaagagaatgtatcgcactggtgatttagccagatggcgtgagaatggctcgattgattatattagccgtgctgatcatcaaattaaaattcgcggcttccgtattgaactaggtgaaattgaaacagtcattatgcagcacccagccataaagcatacatccgttatcgttcgggaggatcaacctggacaacagctgctttgtgcgtatgttgtgctgacagacgactcttctcttcacccttcagagcttaggcagtttgtggctgcgttacttccagactacatggtgccttctgctgttgtctttttgccggaactgccacttacaccaaacggcaaaatcgatcgcaaagcattgccagtgccaaatatgtctttagttagttctgagcgtacacctagaacaccccaagaagacatgttatgtagtttatttgcagaaacccttggcgtatctcaaattggcatagatgatagtttctttgatttaggcggacattctttacttgccgctcgtctgcttcgacgtatacgcgatacattcggtgcagacctaagcatgagcaccatttttgaatcacctcgagtcgctgagcttgcacagcacttagataaagcaaaggacattcggccgccgcttcaggtagaaaaaaggccagatgagattccgttatcctttgctcagaaacggctctggttccttcattgccttgaagggccaagtccaacttacaatattccacttgtcattcagctgacaggtacattagatcaaaaagctctcattgatgctttagcagatatcactgaaaaacatgaaacccttagaaccatctttccaaataagaacggcatgccaagacaggttattttacacccgaaaagtgttcagcctgaactccacgtcacaggttcaagtgatcaacaaattgatcatcagttaaacgaagccattcgctatagctttaatattgaagaagaacctgcacttcgagctgaattattcatacttgatgcaaatcgatccgtgctgcttctattgctgcatcatatcgctggtgacggctggtcacttgcaccattgacacgagacttagctgctgcttacgaagcccgtatacaaggaaaatcaatctccttgccagccgaacctgttcaatatgctgactatgctatttggcagcagaagctgttgggcagtgaagaagagacggatagtctatttgccaagcagcttacctattggacaggtgccttacatgacctgcctgaagaactggagcttccctatgactacccgcgtccacaggaaggaagcttcaacggtgctacgatcgactttacgattgagcccgctttacaccagctgctccttgaacttgcaaagcagcatcaggtgagcttgttcatggtgcttcaagcatcacttgcagcattactgacacgtcttggggcgggaacagatatccctattggcagtccaattgctgggcggaatgacgatgcacttgacgacattgtgggattgtttgtgaatacactagtattacgtacaaatacagctggtaatccaacctttagtgagctattgaagcgagtgcgagacgttgacttagcagcctatgagcatcaggatctgccatttgaacggttagtggaaattctaaatccaacccgctccagatcacgcaatccattgttccaggtcatgcttgccttccaaaatacaccgaaggcggaaatgaagctgacacaacttgactcagatctctacgtgaaaccagtaggatcagctaaatttgatctaaccatcgaattaacagaacaaagaactgaaactggttcagcagcaggattaacaggattgtttgaattcagcacagatgtatttaaacaaagtaccattcaagcaatcgctgccagaatgaagcgctttttaacggaggtagctgagcgcccacatctgccgattggtcaagtgaacattttatcagataaagagcggcaaagatttctacctgacaaaaagacattcgctcagttagaccaagcacatcgtctccctaccttatttgaaaaaacggtgcagcaatatcctgatcgagtggcagtaacggatggcaagaggcagcttacctatgaagagttaaacaacaaagccaatcgtcttgctcatttattaatagaaagaggcgttggaccagaacagttcgttgcacttgccctgcctagatcaatcgatatgctcgtcagcctattagccgttcataaagcaggcgcagcctatgttccgcttgatcctgattatccagtagacaggctggcatacatgatacaagatgccaaaccagtttgcagcatcacaacaaaagctgctgcattgcatctccctgctgattgcgatttgattttgttagacgaaaaagaaacaaatgatcaattacagatgacgccaaatcacaatccggctgatatagacagacttgagccgctatctcctctgcatccggcctatattatttatacatccggatctacaggaaaaccaaaaggagtggtcatcccacaccaaaatgtcatccgtcttctgacatctactgaacattggttccatttcgatgaagaggatgtttggacaatgttccattcgtatgcctttgacttttcagtttgggaaatatggggaccccttttatatggcggtcggcttgtcattgttcctcataccatctctcgttctccagaagagatgctgcagcttctagtcgatgaaggtgtgactgtgcttaatcaaacaccttctgccttctatcagctcatgcagatagacaaggaacaacaaacacttggtcaagcattatcactccgctatgtcatctttggcggtgaagcattagagcttagcagattagaagattggtacagccgtcactcagactgcaagccaaagctaattaacatgtacggcattacagaaaccaccgtacacgttacgtacaatgtactcaatcgagacctgatcgcaaagaaatccagcagcttaataggcgaaccgattcctgatttacgcgtgtacgtactagatgaatacctacagcctgttccacctgggacgacaggtgaaatgtatgtagctggagctggtttggcaagaggttatctaggcaggcctgacctgacatcagatcgattccctgccgatccttatggagcacctggcacaaggatgtatcgaactggcgacctcgctcgctggacagaagaaggggcacttgattacattggcagagctgatcatcaaattaaaatacgcgggtttagaattgaacttggagaaatcgaagccgttctatcacgccacgatgcagttgcacaagttgccgtgattatgcgagaggatcagcctggcgacaaacgattagtcgcatacatcgtcacaactgaagaagaccgtttcgatacagagacccttcgccattttgcgtcagccagtcttcctgattacatggtgcctgcggcttatgtacagattgatacgatgccacttacagcaaacgggaagcttgatcaaaaatcacttccggcacctcaattgcatatacagcaaacggatggccgcggcccaagaaacccgaaagaggaagttctatgccacctctttgaagaggtgcttgatttgccaaaaatcagcattgacgatcgcttttttgatattggcgggcattccttacttgcggttcgtttaatcagccgcattcgtgatgcacttggtgtcaaactaagcatcggaacgttgtttgaagcaccaaacgttgcaagtttggcagagaaactagaaaccggaagtgatgaaaacgcactagaaatcctgctgccgctacgaacaaatggagaaagatatcctctcttctgtgttcacccagctggtggtcttagctggtgctatgcaggtctcttgaatacattagagaaagacatccctatttatggattacaagcacgaggcattgcaagaaaagatgactacccgtacacattagatgatatggctgcggattatatcaagcatatccgaacgattcaaccaaaaggcccttatcaccttcttggctggtcacttggtggaaacgttgtacaggcaatggctacacagctccagcagcaaggtgaagaaatcgctctcgttgcgatgctcgatgcctatccaaaccatttcttaccgattaaagaagcacccgatgaagaagaagcactaatcgctcttcttgcactcggcggttatgatccagataccttaacaggtgaaccactcacgatgaaaagtgctgtcgacatcttgaagaaagacggcagtgcactagcaagcttaagtgaagatgccattagaaatctaaaggaaacctatgtcaattcagttcgattgctcggagaatatcagccaaaaacttatcatggggacatattattctttagatctaccattatcccagattggtttacaccaattgatcccgaagcatgggcaccttatatcgacggaaccattgaacagcacgacattcattgccggcataaagacatgtgccagcctaaacccctagcagaaattggtgtcatcttagacaacgctctgcatcgggtcaaacaaaagcactaagaataaaggagagatgacaaatgacaaatccctttgatcgtgaagacggtgtatttcttgtgcttgtcaatgaacaaggacagcattcactttggccatcatttgcaccagtgccagatgggtgggaaaaggtctttggtgaagacactagaaatgcctgcatcgattatatccagacacactggcaggacttacggccattaagcttaacaaaagaacctgtgctagcacatggaaaaacagactaaatcatcgcaccctgatctgactcagggtgcttttttgacagaataaacatcaccatctttccagctctttctgctacaatttaattgagaatgtttatcaacaaataagagatcaggtggttttatgggaaacaatcaattacgttcaatggcaaatgccgaacaattcatctatcgattgacatttgctgaaaaaataaagaatgcagagcttccgcataaggagcagcagttatcagatacatattgcctcctcgttagcataagcagcagcggcttactcacgctgaacgatcaaaaatggcgattgaaaaatctaacactctatacaattctgtctgatgagacatttatgttaaaaacaaagccttatcaaaaacacgagctctatctgtttcgctttcaaatgttcacgccgcaaggtcaacacctagaagaagtatcaactgaacatgcccggtctttactgaatgtatggcaatttatcgatattagctcaattgaacaaattcattctttactgtccgaaatgacagaggaatggaaaagacatgaatccgttagcttttttagaagccaaacccttttccaacagctcatcctgcagcttttcacactgcataatgaagatatttgtgacacgacacatgcccttttcaaaacaaaacaatatattgatcaacattccgaagaacccctcagccttacaagtctatctcaaatggctggcatcagcgccaatcattacagtgagctatttaaaaagcattttaatgtgagtgtgactgattacatcaccaagaaaaggatggctagagccaaacagttaatggcaaaaggcaacgcaaagctcaaagacattgcactggaaatcggctatcaagatccctattactttagccgcatctttaagaaaaaaacgggcatgaccccttctacttatatgaaaagccgtcagcggaaaattgcagcctatggccattccatactcggtcagctcacacccattcatatcatcccgtatgctgcccctcttcaccctaaatggacagcacatgattttgagcatcatgcagaagaaatcccgattcacctgagtgcacatcggatcaacgagcacgctgaatccaatttacagcaattaaaggaaacaaaacctgagctaatcattgccaatgatcatgtgacagaagaagaaaaacaagtgttgaaaaccatctgtcctgttcactttgttccattcacccaattggattggcgcactcaattcagacaaacagctatgttcctaaacgaagcgaaggaagcagaagaatggttgattcattatgaggagctcgtcattcaggcgaaaaagacatgcctttttgatcattcaccaaaaaccgtcctgcctcttcgtatctttcaagataaactctacttgtctgtaaatcgcaccatgtcagaagtaatttttcatgatattggtcttctgccagcttttcagaatgatggacagctaatagaacaaaaaataaccattcgctccatacaacagctagatccagacgccatcttcctctacttgcataaggagccaaaaacccttgctttttatcaaaagttaaagcaacaggaagattggcaaaatctcaaagctgtgacgcagcaagcagtctatccactagcatctgacccttggcgtgaatacacagcagccagtcataaacgagtcattcaggaccttttatctttttttccgtaaaaagtccatcatttggcagagaattgtctatggataaaaggacaaaagcctaatacaatctttaattgagaacaattatcagttaaaggagaaaacaaatgaaaaaatggttagcattgcttatcctttgtatcatgacgatcaccacagctgcctgtggtgctgcagaaaataaacctgcttcaaacacaaccaaaagcaagtcagctgaaatagcagaaacaagcatcaattacttagatcaaacgtacaaactcaaaacgccagtgaaacgaattgtcattgctggaagcctagaatcaatggaagatgccaaattacttgatatcgagcctattggtgcttctacagtaggcggcgcattccctgaattatttaaagacatcacagcgaaaacagaaggcatcggtgaaaaaacagaaccgaacctagaaaaaatcttaaaattaaaaccagatgtgatactcggatcaacaaagtttccacctgcaacaattaaaaaattggacaaaatccaaacaacgatcccagtatcccatgtctcttctgactgggaaagcaatcttttattgctcggtacacttactggaaaaagtgaagaagcgaaaaacatcatttctgattatcagaaagacctcaaacaagcgaaagaaaccctgaaagacaaaagcagcaacaaaacagctgtcattttacgcattagacaaggcgacctgtacgtgtaccctgaagacgtatacttcaactctaccttatatggggacttaggatttacagcaccaagtgatatcaaaaaagccaaagcacaagcattgatttcattggagcgcctgggcgaactcaatcctgactatattttcgttcagttctctaaagaggaaaactcatcgaaacctaacgcattaaaagacttagagaaaaataaaatttggacaagcctaaaagctgtgaaaaatgggcacatcaatgaaaatgtcgttgatcctatgcttcaaggaggaactgcactaagcaaaacaaccttccttgataaggccgtcaaatggttagagaaaaacaactaaaaaaagaagacaaagggttaatgtttagccctttgtcttcttttcagcttatttgagaatcttgaggagtgaatacatatgaacggaacgtttctatatgacgagtttaacgggcgtcagcttgatatttacgttccacaggacacctctattaatgttccagctgtctttgtacaagatggctcttctttgtttagaacacacctgctagagatcgaaagactgatcgaagccaaaaccatctctccaatcatcattgtcggcatacaccccttcaatcgacttgacgagtatacaccatggaaggcgtcatcactgcactctgggtttcctgactttaaaggcgaggcacagacgtatgtgtcatttttagcgaatgacttgctcccatatatcaaaagaaaatatccagtcaaacagacctgtcatgaacatagtcacataggtgcttcattaggtgggctatttgcaatttatactttattgatgtaccctgctctttttaaaaacatcgcatctatctctgggtcattttggtatcaaaattttctgccgtttgctaaacaacaaagcattcagtatgtggatcaccttatttatttgtctgtaggcagtgaagaaggtaaaggcaaaacatctgctcaacagcacatgcctttattcaataaacaactacatgatcttttattacagaaagggatgcaggaatggcagctgcactatcacatcgaacaaggggagggccatcatctgaaacaatttcaaaaaaatttcttatcagccctaaagtggttttatcaaagagaacgctaattttttatctgcatggcacaaagccgatatgatatattggaacttatagattaaaagaggagggatttgcgtatgagacctttacaaatctcagccgatacagcgcaaaaacttgcggcatcacttaatgtacccattgaacaaattatgcatatgccgcaacatatcttaatcgctaaactagcagaacttgaacagaagaaagatcgttcttcttaaagaaataaaggagtttacattcatggaacaacaactagaacaatcaacattacatccccgcagcaagggacaaaccatccttctgattgctgggattttactcattgcatttaacctgcggcctgccattacgtccgtgggacctctcatcggcgccattcgttccgatttgcagctttcaaatggacttgcgggttttctcaccactttaccactgctctcattcgcattgctttctccaattgcacctaaaatcggaaagcgtcttggcaatgaacgaaccctttggcttgggcttgctgtccttctatttgggattgtgattcgctcgtttggctcgatcaccttcttaatggtgggaaccgcgcttgtcggtgtcgggattgcgatatgtaatgtgcttttaccggggctcgtgaagcataaatttcctgcacatgctggtttgatgacgagcgtgtatacgacttcgatgtccgtctttgcggcacttgcatcaggtgtcagtgttccgctcagccatacgatgcctggcggctggaatacttcattcctcgtatgggctggccttgcacttctcgcgatgatggtctgggcgccgcagcttcttcatcagaacacagcggccgtcaaaagcatttcgctcaaagagcagccgatatggcgttcgcgtgtcgcatggcaggtgaccttttttatgggcttgcagtcattccttttctatagcagcatcgcctggtttcctgatatcttaacatcacatggaatgaacctgtcgacagccggctggatgctgtccattatgcagtttgctgggctgccatcaaactttttagcgcctgtttttgcagaaaagttaaaaacacaaagaccgcttgtcttcggtcttgtccttgtgtatttacttggtatgatcggacttcttctcggaggatcgacgcctattcttgtgatctctgttttattgatcggcattggacaaggtgccagcatcagtctggcgctcacttttatcggtttacggacgaccaatctggagcaagccgctgccctctccggaatggcgcagtctctcggttatttattagccgccgttggtcctttcatgatcggtatcctttttgatctcacacatacatggacgccatccattatcatctttatcatcatcttatttttcatgcttttatccggtatgcgtgctggacgaaacgtctatatatcagatccatcataaaaaagaacccgcctcctcatgagagacgggttctttactgtttatgcttgttctgtcacgtgtacctttaatgttgcttgtacctcaggatgaagcttcaccggtacatttgtgtaacctaatgcacggatggcgtcatttagctcgattttgcgcttatcgactttgatttgatgatccttttgcaatttatcagcgatttgcttgcttgtaattgatccaaacagacggccgccttcacctgattttgctgttagttccactgttagcgcctcaagtgtttcttttagttgtttcgcttgttcaagctcttggatggcattctttttctctttgttcttctgcccttccaatgcgcttaggttcgttgggtttgcttcaactgctaacccctgtttgatgagaaagttgtgagcgtatccgtcagctacattcttgacttcgccttttttccctttgccttttacgtcttttagaaagatgactttcatctttgaacccctccttcgaaatattcatcaatggcagcttttaactgctctaccgcttcttcaatggttataccatacatttgggttgcagcgttagttaaatgaccgccgccatctaacgcttccatgataatttggacattgatatctcctaatgatctcgcactaatgcacaccgtgttgtcatctcgtcttgcgacagcaaatgacgcttctacctcactcattgacaacagggaatcagccgtctgggcaatcgtaatttgatcataatactccgagctgtctgacggtaatgaagcaatcgccacctgatcttgatacagatctgtatgctgaataagttttgcccgtttgatgtaatgatcgacggtctcttttaggaatttttgcacaaggacaggatctgcccccttcgcacgaagataggaggctgcatcaaacgttcttgatcccgttctcagcgagaaactcttcgtatcaacgatgatccctgcgagaagcgcagtcgcttcaatcatgttaatgcgcaatttcttcggctgatactctaaaagctctgtcacaagctctgctgtggatgatgcatacggctccatatagacaagtaatggatcacggataaactcctcgccgcgtctatgatggtcaatgaccacgacattttcaattttattgagcagccgttcttccataacgagagacggtttatgtgtatccacgaccaccagcagcgtgtcatcctttgcaagctccatggcttcctctggggtgataaaacgtgaccaaagatcttcataattcttaatttcactaatcaaacgttgaacactgtccccaatctggttggcatcaatgacaatatagccttctttcccattggcctgagcgacctttaaaatcccaatggatgcaccgatcgagtccatgtctgggaacttatgccccatgatcatgacattgctgctttcagatacaatctcttttaaagcatgagaaatgactcgtgcgcgtacacgtgtccgtttctccattggattcgtttttccgccgtagaatttcacttttccattcggctgcttaatggctacctgatccccgcctcgtccgagggcaagatcaagactcgactgcgcaagcgccccaagctcttttaaagaaggcacggacgcaccgatcccgatactcagggtaagcgtcgcactatgggctcctgttttctcacggacctcgtctaaaatagagaatttcgacgcttccagctctgctaaaatactctcatttagaaccgccataaatcgttcggacgaaattcgcttcaggaaaatgccatattcctgtgcccaattgtttaacagagacgtcacttcactattaatggtgctgcgtacctgatcgtcaagaccctgcgtgacatcatcgtaattgtctaaaaagatataagataacaccgttcgttcattttcgtactgtctttcaatctgtacctgttctgtgacatcaaagaaatataaaaggcgctctgaccgtttaataataactttgaatttccggtcattcagtgtcacattttctgtctcgacctcttgtttaattagaggcacaatggactcgaatgtatcatacaaggatctgccgacaagcgtgctttcatgaaaacacgaagcgagaaatggatttgtccattcgatataatactggtcattaaacagcataataccaattggcatttccattaatgcttcttctccaacctttttgactcgataggataatgttgaaatatatgaatcaatctctttttgcacttgcgtatctgcccactttaagaggtagagcacacctgcaaggactaaaagaccaaccgctcctatgatccaattataataaaggttgaggaggactgtgaccaccgctaggacaatcaaagcgatgatcggatacttgatgacaggttttctatagaagcttggcactgatatcaactcctcaacattcagagtgaattatttgttttttactttttctcttaaatcaaagcctatgtcagcaatccctataatacgcacaatcacaccgactggcggatagagaacccctaacacgacagcgaaaatgggcaccgcttttgagatgcttttttcatggcaataatagaagataaaagaaaatccctgaataagcaccagtataaataaaatttgaaaagcactcgtttgaacgagccataaaaagctgcctttttccgtctgaatcagcatcaaaagcagtgtgagtaaataataccataccatgctttttggcagccgcatatccttaaatttcttcaaggctggcatgtctttgacaaaccgtttgatcagaggctgcacgaaccagtggttcacgaacgccagcaacgtgacaccaattaacagcgcgacaggtaaagcactcaatgcggaatcctttatctctctgaactgcttcagctgcttcgcaatgtcctgctcagaagcaccggattgctttaaggcactctctaacattggaatcatttgctcaatcgactctttcgcgacactcataatatcgacttgaaaaagctgaacactgacaacaaaggagataaggaaactgaataaatagatcagcgcacctgcaatgatggcattcccaggctgccgtctgctgtagaaaacacccatgcctaatccgacagcaatcagaattggtgcagtcatgagtccattaatagacccaattaaaaagctgatcactatcccaatagcgccagcagcaattccttttttcaaaccgtgcctgattgtatagaggatgatcggaatcggagcagccagaaagaaaataatggataatagcggcacatacaaataaaacagcgtcatgacagagaaaatactgatcatgatagcgccctctactaacgcttttgtttgtttcacaccttcacctctatccaatccttttactatatcttgctcaatgtgtccttctatgtatacgtacgatgtaagctgcaccatgtcttaccccaacctttattttaccatagcggtaaatcgcaagtaaaatgcagtctatcttaggagcgtttcacgtggaacactgataccaattcgtacatgcaacttttcaaacagcatgttacaattttttagattattcttagctataaaccctgaattcaaggacaaaagctgttagaatagaaacatcatcaataaatgtaagaaggagaattcatatgggaaaaacactcgtattcggacacaaaaaccctgacacagacacgatttgctctgctatcgcttacgctgatctaaaaaacaaaatcggcgtcgaagcagaagcggtcagacttggagaaatcaatggagaaacacaatacgcattagatttctttcaacaagatgcacctcgtttcattgaaacggctgcaaacgaaacaaagcaagtcattcttgtcgatcataacgaattccaacaaagtgtaagtgatattgatcaagtacaagtgactgaggtcattgaccatcaccgtattgccaactttgaaacaagtgaacctctatactatcgcgctgaacctgttggctgtacagcaacaatcttacacaaaatgtacaaagagaaccaagtgaagattgaaaaagaaatcgctggtttgcttttatctgcaatcatttctgattccttgttattcaaatccccaacatgcacacaacaagacattgatgctgcgcatgagctagctaaaattgcaggggtagatccggaagcttacggtctagacatgctaaaagctggcgctgacctaagccaaaaaacggttcaagaattaattacaattgatgcaaaagaattcgcactaggcaatagcaaagtggaaattgcgcaagtcaatacagtagatattgcagaagttacagcaagacaggctgacattgaagcgaaaatcaatgaagtcatcgcagcgaaaggtcttgatctattcgttctagtgatcacagacattctagaaaatgactctcttgcacttgcactcggtaccgaagcgttaaaagtagaaaaagcatttaacgtcacacttgaaaacaacaccgctttactaaaaggtgttgtctcaagaaagaaacaagtcgtacctgcactgacagacgctctttcttcataaacacaaaaagactgctgacctgttcagcagtcttttttcttcttttaatgaatgtacatatcgctgacaagaatatcctttaatacacttgttggaatcgtgaattcaactacacccatgtaaccaggcgccacatcatattcattaaaggaaatcaccagtttgccttttgaattgatatagaagctttgatctggctgaatcttcttaaacggatcaaccgtatcttgcttggtaatccagtaaatcttatttgaatcctttttcatctgtttcttcatttgttctttaatattttcactaatcacatcaatataacgatcatctttaaacaagcttggtaatgtaatgagtacatggtttttcttatccaccgtatcatacgtcatttcctctgccgcagaagcctgagtcgtcaccttgtatcgacctagtgaaagaatttgatcattgtttgttttcacttcatatccgctctctacactcaaatgaccatttttataaccctttgtttccttttcaaaatcttgatacagctttttgttttcagctaaatatttttgattcaggctgtcttgtaattttccgtccccaagccctgaaacgtgtggtgttttgaggtcaatattcgttccttgatcactctttttaaattctgtgaatgtcacgacttttactagctcgccaatgacaggaatttccgaaatcgctcttgccgcctgcgggctgacattcacagtcgtgacaaataaagcagccgcagcaacaagtccgatcgtccattgctgaaaatgaggttttttgttttttcgttttaatgttcgttcaaccatagcatcaaattccggcggaatagggatttctaaatattcctcttttaactgtttcaaatgcttatccatttatatttcctcctgcgataattctacttttaaaagccgcaacgctttatataatcttgttttgatggtgttttcgttttcttcgagaatgtgggcgatgtcctctagttttaaatcttcaaagaatctcaaaataatgatgacccggtacatgtcgggcaaatcctctatggctcttctgacatcttgatcttcatagacatctgattcaccctgtgataagaactcaagtgtatcatcgtctgtcacctgcacccgcttcttctttcgtaaaaagtctagggcagcgttcaccacgattttataaaaccagctatgcattttggccgcatcctctaatcggtgaacagatttgagtgctttatgaatcgcctcttgaacgacatccatcgcatcttccgggtttttgacataactataggacaatcgataaaaactgtgtttatgctccattacgtaatcagcaaattgatcctcaatttttcgtttcttcattttacaaagagctcctttatcttaaatgcgcatcggttatttcttacaatggatagacgcgcaccttttgaaaatagtttgcgctcgattatttttttaacatgtcattccatttccgtttctatacaaaaagagcgaaccagacaggttcactccttcaaagcggatattgtttgatggacaaattgtttaagtggggaaagcggctgaatgatcggaatgcctgtctccttttccatctgctgtgccgcatgaaccattgataactgcatcacgcaaatgtctccactttttttcatacatcttctgagctgctttttaatttgctcctcataagcggacatatcaccgtttaggcaaaggtgaaagacatcctccattaccataacctccgcatcaatttgtttgccgtgctcttttgcatatgactttagccgctccatagtcccatccactgtatccgggtttgaaaatacaagttgaagaggcccttttctctgacaaatcagctcaaataacggctcatcgatcggaacaatcggttgtttaatgagatgctgctgatcgcccaaagcggcaatatattgtgtacacgtgagcaaaatgatgtcggcttcatcttctttcatcaatttgttgatggcataggtttgctgcttgtgaaggttaaaatctggatcttgtgtggcacgttctataaatgatgaatcgaccgtgtgatgaagctcaatttcagtatcatgaaacacgtcttctatataggactgattagacggatgggcatgaaggcagtgtaatcgaatcatcaggttcgctcctcgtgaaagttttcaatcattatatcaatccttgtatgaaatagggagaaagatgaccatattgttagggagatattgaaggagggattcgaaatgaaagaagatcaacaccctaagccatcctcagagtcagaagacactttaacaaatcggcaaggtcaccccgtaacagacaatcaaaatatgagaaccgttggaaatagaggaccaactacacttgaaaactacgattttctagaaaaaatcagtcattttgatcgcgaacgtattcccgaacgtgtcgtccatgcgcgcggggcgggagctcacggttactttgaagcctatggcacattcggtgatgaacctatttctacttatacaagagcaaaattatttcaggaaaaagggaaaaagacacctgttttcgtccgtttttcttctgtcattcacggcggtcattcgccagaaaccttgcgcgatccgagagggtttgcgattaaattttatacagaagaaggcaattgggatctcgttggaaacaacctgaaaattttctttatccgagatgctttgaagtttccagatttggttcatgctttcaagccagaccctgttacgaatcggcaggacggcgagcgtatttttgacttcgtctcgcaatctcctgaagcgacacatatggtgacatttctcttttcaccatggggcatcccagcaacctatcggcacatgcaaggctcaggtgtccatgcctacaaatgggtgaaccatgaaggaaaagcggtgctggtcaaatatcactttgaaccgaagcaaggcattcgcaatctgacacaagaacaggctcaagcgatacaaggtgaaaactttaatcatgccacacaggatttatatgaggccattgagcaagaagatcatcctgaatgggaggtctatgcacagatcatggaagatgatgcccaccctcaccttgattttgacccgcttgatccgacaaagctatggtacaaggatgactatccatggaaaccgatcggacgaatggtgttaaacaaaaatccagaaaataatttcgctgaagttgagcaggtcgcctttgggactggcgttctcgtagacggtttggatttctcagatgataaattgcttcaagggcgcaccttctcttactctgacacgcagcgatatcgtgtgggaccgaactatttacaactaccaatcaatgcaccgaaaaagcatgtcgccacgaatcaaagagatgggcaaatggaataccatgtcgatcaaggcaaagggcaaaatcctcatgtgaattatgaaccatcgatcctcggcggattaaaagaagccaaacaggatggaaaggatcatacgccttttgtagagggtgacgtcaaacgggaagccattgaccgcccgaacaacttcggacaagctggagaaacgtatcggcgcttcaatgattgggaacgtgaggaattgattaagaacttagtcaacacccttgcgacctgtcaaaaggacatacaagagcaaatgatcgaaaactttacaaaggcagaccctgattacggaaagcgtgttgctgacggcttaaaagccttcaaacaagaacagccgagcggacctataggctctacaggcgctgccgaagccgtggacgaagcaattaacaacagcacaccatcagatccttattaaataaaaaagaatgcagcgcctaggctgcattctttttgtatccatcgattaagcgttttgaccctttttgatccattctgctacattgactgtacgttttgcttgatgttttgcagcagcttctgcatcctcttgaatctttccgttttggtcaacagtgacactcacgccgtaagggttgccccctgcaccgtacaatgagtcatctgtgtatccaggagcagcaataatcgctccccagtggaacatcgttgtgtaaaggctaagaatggtctgttcctgcccgccatttgggttttgtgcagaggtcatcgcacttactgctttgtttgccaatttcccttggaaccataggccgccagtagtgtctaagaattgcttcatttgagccggtaagttaccaaaacgtgttggcatgctaaagatgatggcatctgcccactctaaatcacttaattgaacctcaggaacatcctttgtttcgtctaagtgcgctttccatgctggatttgatgctacaactgattctggtgccaattcagcaacctttaatactttaacttcggcgcctgcttctttcgctccagcctctgcccattttgccatctgatagtttgtacctgttgaactataataaataactgctaattttacgttttccatttgttccatctccttttgtttggtttgcccaaaaagcttctgtaaaaaacccatctatattccctaccttcattaaaattgacgacgataccataatgccgcagcatcgacttcttctctcgttagctgatgtccgcgattttcccaatgtagtgtgactgaagcgcctgcgcctttaagcaattgctcgagctcttgtgattcctccgggcggcacattggatcattttcaccagctgcgataaagacttgtttccccgccaatgaaggcaatgaaactccgcgtcttggaaccattggatgatgcaggatcgctccttttaacgcatcctcgtaatggaataaaagacttcctgcaatgtttgccccattggaatatccgagagcgacgacattgtgacgatcgaacccatattcatctgctgcttctccgataaatgtatacagttcctctgtccgctcaattaaatcctgctcatcgaatataccttctgctaaacgtctgaaaaaacgcggcataccgttttccaacacatttcctctcacactaagaatagaagcgtcagcatcaactaaatcggcaagcggcaataaatcttcttccgttccgccagtaccatgcagtaataacaaaacaggtctttgttcattctttccttttcgaaaaagatgtttcatcatgcatctcctttccctttcaactctctcacttctattggcagcacaatttgttcaatctgactgcgctgcgcttcatattgcggtggcagtttcaatgcttcccccatagtttccactgattcatcgtgtgcaaaccctggaggatcagttgcaatttcaaataatatgccgccaagctctctaaaataaatggcattgaagtaatttcgatcttgcacaggtgtcacttgatacccgctttgtgcaatatgtctttgccaatctaactggtcctgatcatctgacgctctccatgcaatatgatgcaccaccccaacacccatacgtccgcgtgcaactggtgtcttgttcacatcaatgacattgccgatctcaccaaacgaacggaatctcacatagtcctcttcttctccaacgcgttcaaaacccattgtttgttctagcagctgcatcgtttgctctggctgtgatgttaataaaacagctcccccaaacccttttatcgcaacatctggcgtaacgccgttaaatgtccaatcattttgttttccctccgcgcgttctactagctcaatcaacaagccgtgtggatcttcaaatgagagaaaggcttcatcaaagcgttcgaccatttcataagaaacatcaaactgctcaagacgttccttccagaaagagaaagcgcctggtggtacaacatatgtcgtcacgcccacttggcctgcgccaatttgtcccttttgagcacctggccaagggaaaaacgtgataatcgttcccggagatcctccttcatttccaaaatataaatggtaagtgcctggatcatcaaaattcacggtcttcttcacgagacgaagtcctaaaacacctgcataaaaatcaacgttctcttgaggatgccctacaattgctgtgatatggtgaattccttctgttttcttcacttctaatgacctcctaatcatgaagtaacaagcctctattcattatgtctttactgacgtctttatattatctcgaattcgagatattaaaccaaaaaaatatatttatctcgaattaaggatatgctgtttttaaataaaagtcaacgatttttgtttttccttttaaaaaagcagatctgcttttacataacagacctgctcttccatgattatcgcagtaattttttcttttttaaataggctttcgctacctgaaatgcatccttacctttcacattcacttcataattcatttctctcatctcatcgtctgtgatttgaccaccaagcttattgagagaagcctcaatctcagggtactccgttaatgtctcctgccttaacagcggtgctccttgatatggcgggaaaacatgctgatcatcatcaagcacctttaatttgtattgcctcaattcactgtctgtcgaatacgcatcgactaaattgatatctcctttttgaatcgctcgataccgaagcttcggttccatcgtcactacatcatcaaaggaaaattgataggtcttttgaatacctcgatacccgtcctgtcgatcagaaaattctaaggtgaatccagcctttatgcgattcttgattttagctagatcagaaatattggatacatcatattgatcagccagcgactgaggcacggctaaagcatacgtattgttgtaagccatcggctcaagaaggcggagctgaaaggatgattccaaaccgcgctgcgcttgctcatatactttttctttatctgtgcttttcgctgtttgtttgaggaactcagaaattgcagtacccgtaaactcaggataaatgtcaatatcaccagaacgtaaagcttgaaaaacaaaagatgtcttgccaagaccaggcttaagattgacttgaatatccgtatcctgttcaatcaaaagcttatacatcgagatcagaatttcaggctctgatcctagctttccaccgatggtgatttcttttttttcttgttgaaacagtgctgggcccgcgacaatagctcctgcaatcacagcaaaaaccgtcacagaaatcacagtctttttaaaagaaattttctcaaacgtacgcagcaccacatcaaataagagtgcgagtaaggctgctggtatagcgccaatgacaatgagtgacatatcatttcggtcaattcccagcaaaatcagacttcctaatcccccagctccgatcagtgcggcaagagtggcagttcccacaatgagaaccatcccggttcggatacctgccatgataactggcatggccagaggcagttccacctttaataaccgtttacgatgattcattcccatggcaagcgccgcttctctcagggaaggatcgacctcctgaatacctgtatatgtatttcttaaaatagggagtagggcataaacgacaagcgcaataatcgcaggcacttgcccaatcccaacgagaggaatcagcaggccaagcagcgcgagtgacgggattgtttgcaagaccgccgtcaccccaatcacccactctgcaagctttggcaccctcgttaaatagatacctaagggaatggcaatcaaaatggctaaaaataaagcaataaacgaaatttgaatatgctcaagtaaggcgtgacccaattgttcttttcgatccaataacacattaatccaatcattcatgtgactcgcccctctcactaggtgaatcagctaaaaactgaatcacagcttgacgattcactagtccaattcgctccccatccttttccacagccaattcctcatgctttgccaattgggataagacctcatccagcgtggcatgtgctgtgatcacttcatagcctaaaagagcctcgtgagccattggtctagccaagacttctagctcaaacgcatgatgccccgcatggcgagcagccccggagacaaactcccgaacaaaagcattgactgggtgttgaaccaattcctctggacgaccaatctgcaccactttcccttccttcatgatacaaattcgatcaccaagcctcatcgcctcctgcatatcatgtgtcacgaagacaatagttttttgaatacggcgctgcaaatcaagcagatcatcctgcaatttcccccttgttaatggatctaacgcactaaagggttcatccattaggacaatctctggatcagctgcaagtgcacgtgccacaccgacacgctgctgctgtccaccagatagctctgacggctttcgatgtcgatacatagcagggtcaagcccaaccatctgcatcaattcatccactcgcttattgatctcataccggctccattgtttgagctctggtactacagcgatattctcttcaatggtcatatgaggaaaaagagcaatttgctgcagaacatacccaatatcccagcgcagctcatacaggtcataatcatttattttttgaccctttatgtaaatctcaccttctgtagaagaaatgagacgattgatcattttcaatgtcgtcgttttcccgctcccactaggtccaatgaacacaaaaaactcacccttttgaatctctaaatcaacagattcaacggcataacgctcatctgaaaattgcatcgaaaccttcctaaattcaatcatctttccacgccctgactgcaattattttctagactaccaatatgacagatcgaccccatatttgtatagaacaaactgtcacttttactctcttttacatacttcccctaaggtgcacgccaaaaacagctctagtcagttcggctgagatctccttgagacaataaaaaaagcggagagctcgaggctctccgcttttaagtcaacgacttactcaccagtaacgtatggaagtaatgccatttgacgtgactttttaatcgctaatgtcaatttacgttgatacttagcgctagttcctgttacacgacgaggtaaaattttaccacgctcagaaacaaactttctaagaagatcaacatctttgtaatcgatgtgcgtgataccgttagaagtaaagaaacataccttacgacgtttcgcacgaccgcctctgcgtccacctgccatttgttttcacacctttcctttagtcattagttttttcagatcaattagaatggcaaatcatcatcggagatgtcaatcggtttaccgtcattcgcaaatgggtcatcattgaagctatttccctgattacgattttgttggttgctttgattgccatatggattttgacttggttcatttccaaatggattctgatcgttttggctaccgccataatactggcctccgctattaccaccgccgctgtatccacctgaaccagcaccgccgctcttaggctcaagaaattgaacactttcagcttgaacctctgtcacgaagacacgctgtccttgctgattttcatagtttcttgtctgcaaacgaccgtctacaccggcaagacttccttttttcaagaaattagccacgttctcggcttgtcttctccaagtaacacagttaatgaaatcggcttcacgctctccagattgattcgtaaacgtacgattcacagctagagtaaacgtggctacagccgcaccattaggcgtgtagcgaagctcagggtcttttgttagtcttccgaccaatacaacacggtttagcatattgaaagaccacctttaaatatatatttcaatgatttatacttcttctttaacaacaatgtggcgaatgatatcgtcactgatcttagctaagcggtcaaattcttgaactgctgcagcgtcagattgaacgtttacgatttggtagaagccttcacggaaatcgttgatttcgtatgcaagacgacgtttaccccaatcctttgttccagtgatctccgcaccgttagaagttaacacgttattgaaacgctcgataactgcttttttagcctcatcgtcaactgttgggcggatgatgtacataacttcgtactttctcatctgattgcacctccttttggtctaagcggccctatacgggcaaggagcaataaattatattactcacaattgtatattataacaaattacttggcctatgacaagaacctatacattaaaacggaaatgaatgacgtctccatctttcactatatattctttaccttctagacggacttttccagcctcttttgcagcagacatacttccaccagcaagtaaatcttcatatgcaaccgtttcagcacgaataaacccacgttcaaagtccgtatgaatgattccagcacattccggtgccttcattccctttttaaacgtccaagcgcgtacttcctgctcacctgctgtgaaataagtagctaaaccaagaagtgaataagatgcttgaatcagctgatctagacctgactctttgataccaagctcttcaaggaacatctgcttctcttctccttcaagctctgcaatttcagactcgatcttcgcacaaacaacgatgacttcagcattttcaccagaagcaaactcacggatttgctgcacatattcgttgccgtcatgatctgctacttcatcctcactcacatttgctacataaagaactggtttagatgtgagtaaatgaagctgtttcacaagcttctgctgctcatctgtaaattctacagatcttgccgatttcccagcttcaaatgcgtgcattagcttcgacaaaatatcaaattcagctaccgcttccttatccttttgttttgcaagcttactgacacgagccaaacgtttttcaactgtttctaaatcagccaaaatcaactctaaattaatggtttcgatatctgacacagggtcaaccttacctgatacgtgtgtgatgttatcatctgcaaaagctctcaccacgtgacagatcgcatctacttgacgaatgtgagaaaggaatttattccctaaaccttcaccttttgaagcccctttgacaataccggcaatatcagtgaattcaaaagcagtcggaactgtctttttcggctgcaccaattctgttagtttttgcaaacgttcgtctggaacttctacaattccgacgtttggatcaatggtacaaaacggatagttagcagactccgctccagcctgtgtaattgcattaaatagcgttgacttcccgacgttaggtaagccaacaataccagctgttaaagccattctttcatctcctctatatcaaacgtgctcgttatactgcgtaatatgaacctagagcaattataagtaggtttacatgaaaagacaagctaaccattatgcattatcaatagaagaaacattgccaaaaagaataaatcaatgctttaaaacgggaatttgcatctaattcttctatacaaaagacgaatttcattaaaaaagcatgaggcctacttaaacagttggctcctcatgcttgacgagaattttcttcaattttcgttcaaagtctcttcttgggatcatgacgctatgcccgcaaccttcacatttaatgcgaatatccatgcccaaccgaatcactttccaccgattgacaccacatggatggggtttcttcatttcaacgacgtcatgcaacccaaacgctttgtctgccatcagctttcacctctcttgctcacttcattgaatctattgtacaaaaaaacggcgatgaagagcaatgcacaaaacaaaggccctctttcaatcgttcctccttttcttttttatagaaaaaacccttcttttagatcatttcatttgtgaccaatagttacttaaactccgctttttttcaatattgtcacaaacactgtaggtcaaaaggtttttattggtagaacgctgtggtttttccatattttttgatttatgatatctgcataaatgttatgtgagggagcaggtacgatggtcaatcgaaaggatagattaactgataaagaatataaaatcatatccgatcatgctggaaacatagataattaccagcagcaccatacgatagaaataggtcagcaaatgctcactgtccatgattttctcaaggtcgatcatcaattatatggtttaacgatgcagccggaacaatcagatgagttcatcgtcgcttttcactgtccgatgccaaagcaaatgccggtgacctcgccacaagatgtacacaccgcggcacagtcattgcttaaaacggattatgcctatcccattgaaaggaagtcccttgatgtcaatcgagatcatgtcttttttaaagggaaggaatacatagagcaagtcagtcagaagcatcccaatgcaggtatctatctcactggacaagcccttgccggtgctgtttgtgcttatgttgcaacagaacagccagctgtcaaaaaagccgtcacctttgatagccccaatatatggagcagtctggcgccttcgattcagcagaaagcgcagcaaggtcaatatacacggatcttgactgaatacattcaacctagtcattatgtaggtttactcaatcgtcatgatcatggagttggtcaagtgaagtataccgtgccgccacagcagcaaggcgatgtccaagaacctgttaaatataaacaaagagaaattgacacctttttaaaatcagcttttgcgtctatgaatatagaatggaacgaatcctttgatacaaatgcttttttagcgcttatttctgggagcttaaaaggaaatgggtattcattccacaaagatggatctgcccgaattttagatgaacagcttgatcataatacaagttttacagctatgctgttgcaagaaatccattctggacgtgcatatgcacaaagtggtctagaaattatcataaaatcccatttactgaaaaattcatcctacgatctccaaagtgtgattgaacatgaagtacacactatatttgataaaatcgatgggatcgatgaaagtgtaaaagacgccgtccagcatgtaaaacaagagctcaaaggactcgtaggctttggccactatgatttattaagtccaagtgatgtggaagcactgatagaagaagtcaggatggaacaacatcattcctccttttattcacatgaaaaacaactgaatgccctatacaccttgagagattacgaacaagaactttctaccctttcaagacatatgtacacaatgggtgatgattacgccaaggcagataggcgccttgcgatgcaaatgggtattcattaagaaaggagtcgccgcatgatcaatcaaaataaacctcctagtgacgcccagcgtttcttgcaaaatgtgagtgcccgccgatccatgtctgtatttgaaaatcaatcggcaccacaaacacaaacgcagtccccagaagaaatagccgcaattcaggccatacgaagagaaggacagcgaaaggatctaaaacggctgctcaaaatgcggctgcatgacgaattagcaaacactcgtgtgcacttggagtatcaattgtctaaaaccgaagacatgatcaatcagacgaccattgtcaaacaacacatctcccagcatttaaaaggacaagccatttcagaattagaggaacgccttcagcgtctcaagcaaatgccagtctatgatgatatcaaagacgccattgactctattcggataaaataagcacagctctgacaaagagaggtgcttattttattttatcaatataatttttagggcgagaaaatatctttttacttaaaatcggatatagcattaaacacacaagcaaataaagattcagcaagctatatatcggatataagaaagcaattaaatcggcaaatccaagagatgtcaaaggcgccatcaatagaagcattacgaaaacaaccaaccagcggggcaatggtacaaaagagagcattcggctcgataaaccaaataaacctgccgctgtcgtcgtataaatggctagacaaaggacaacagtcataaacacaaacaatgatgtcggcgctccttctaatactgtaaacaaaggaatgccttctgctgataggctcccagaaatatcaaccagtatttcgttatacacgtacgagatgaccccaaaaatcaggccacttaatatactcgccactttggcctcgccaaggcccttcatttcttttccaaccgaagacagcactgcgaccacagataagatattcaaagaagcaaagacaatgctggcaggccaattatactgctgcccaaaatcgatccgccacatatgatcatggttcatataataaaaaacaaacgcatagatgagccccgccaccaaaattggtataatgaaagcattcacagataagagccctttcacatcccagaaaaaaatcataaatgaaaataaacaaaatgcaccgatacccacccaaaatggcacatgatacatctcgagcgtcactccgccaccggcaatcatgactgtcgttgtcgtgaataaataaaggacaattaaaacgtcatacactttagccagccatggacctacaagccgctctagcactggcacaaagtgatcggcacgtacctcataactgatttttaacaccacataggtagacagcatgaacatcaatgtaaacagtagaatggctagtccactatcaatgccaaaaaactgccaaatttcttggccggaagcataccccgctcctattaagcttcctaaaattaaaagcgtccaccttgaaccagccttccacacaatcatcacctcataggtatagaattaagcttgtttccgtatactgttactaactactatgacaaggaagtgagacctatgaatagcaagaacggtcttttttttagaaatagggtgaaagaatacgtgtcccatacggatacaaacgccattcaacagcttaaaagtattttattctcgcatcttcagaaagcagggaaaagacccgttgccatcgtttgtattggaacagaccgctcaactggcgactctctaggtccacttgttggtacaaagctttcaggtcttgatttgaaaaagcttcatgtatatggaacgctctctgatccagttcatgcggtcaatttaaaagaaaagctcgctgaaattgaacaagctcataaacatccgtttattgtagcgattgatgcctgtttaggaagagtgaaaagtgtaggctccttccaaattggagatggaccgttaaagcctggagcgggtgtacaaaaggagctgccagaggtaggagatattcatattaatgggatcgtcaatgtgagcggctttatggaatacttcgttcttcaaaacacacgccttcatcttgtcatgtctatggccaatacactttctgaaagtctatctcatattgatcaaatggattggacgagagaaaaaaaccgttctcttttcgcacctattcaaaatatcactgggagaatataaaaaagaccatctcgtatcaagatggtcactctgatgcttctctcgtagaaagcaattcaaggattctttctaaatcttcgttggagagaaattcaatctctatttttccttttttcttctgtttcttgatcgtcactgaagtgccaaagtagttttgtaagaaagactctctttctttcaacactcgatcctttggtgcttcttttttctttgtttcacgtggaacattttcgtttaactgctgaacaagtttctcaacctgacgtacgtttaacccctcgtccacgattttctttaccaatggcgccagcttatttttatttttcaagctaagcaatgttcttccatgccccatcgataacgttccatctgcaatcaggttttgtacttcatccggtaaagtcaaaagacggagatggttcgcaatatgcggtctgctcttccctaatcgcttcgctaattcctcttgcgtcacacttaggtgatctagcaaagaagcataggcttccgcttcttccaatggagataaatcctcgcgttgcaggttttctaaaagggcaatctctctcatgagcgtttctgaaaattctctgacaatcgctggaatcgttgtcagaccagcttcctgtgctgcacggaaacgacgttcacctgctacaatgtcatatcctttaatcgatttacggacaatgatcggctgtaaaacaccgtgctgctgaatggattctttgagatcagacaatgcatcttcatcaaacgttttccttggctgatatgggtttggacgcaattcctttattttgatttcttcaaccgtttcttcatttgagtctacagtgttaaataatgcattaataccctttccaagacctttagccattcgcatccacttcctttgctaagtctaaatagacatctgcacctcttgaacgtggatcatacaagataatcggtttcccatgactaggcgcttcactcagtctcacatttcgcggaatcacggtctgatagactttatctctaaagtatttcttcacttcttcgatgacttgaattccaagatttgttcgtgcatcaagcattgtcagcaagacaccttcaatggcaagatccgtatttaaatgcttctgcacgagacgaacggtgtttaacaattggctcaatccttcaagcgcataatattcgcactgtaccgggattaaaacggaatcggatgctgttaacgcattaatcgtcagtaatccgagtgatggcgggcagtcaataatcatataatcataattttgcttaacagattcaagtgctctcttcaatctcacttcacgtgaaatcgtaggcacaagctctatttcagcccctgcaagctgtatcgtcgcaggaatgacatcaagattttcgacctctgtcgtcttaattacatcaagaacatctgcatcatcaactaaaatatcgtacacgcacttctctacgtcggccttctcaatcccaataccactcgtggcattgccctgcggatcaatatcaactaacaacactcgtttacctatgtatgctaaacacgcactcaaattaacagaagttgtcgtcttcccaacgccgcccttctggttggtaatcgctatgatttttcccacgatgtcacccactttcaacttaacaagtttctcattcattcatacttcctattctatcaaaaaaagtatgaaacgtttgctttttttgtttctccattatatattcgtcagcaaatgtctattttcgtacatgaaaagacgaacctaaacgcattgaaaaatatatcaatatatcttttttcgaaaaagatgtgcataaaaaaccctcacttccatcaaaagtgaggggcacttgtcaaaaatgtaatccgccaattgtacggccttcgttcacaataatcttaggggtcaccgttttatagcttcttttttttaagaatccatagggggtcttaatggtaaatgtcgcatgtcctacagcatctcctgttttagcataggcctgccacacaatctttgaacaataagttgggtccagcgattgaattgacatggtgatggagtaacgagcctttggatgagctttcacataatcgcgtgcccattctcctgccaggtctgctgtgtcttcttgattaatacgaatgacctttgtattggcattatagcgaaaccagttaagaatggaatcaatctgaggatgctgtcgaaacccgggaatagaagcaaagcttttctcattaatgacgatacctgcatgtccaacgattcccttcaaagcatcagtatttgtcaccaatatatccccttttttaggcaaaatatcggtacctggatacggctttcctaaaaggcgcttgatggtgtgcggcttttcatccgtcacaaactcatcctgcttgttttgttgtaagccataatccttcaaatgatcgccagctgaaatcaagtcaattgtgtcatcctgagactcatgatcatgatttaattgatctaaagtgatctctttcgaaacagcaccttgtttcttcaggacgttcagttcttttttggtcagtggactttcttctgcaggaacggttggcgaattcacagcaaatgtggttgtttcatttgtaaaaagaaaaaaagaaaatagtaaataacaaataataacaaaattcatctttttcattttcatctagttgtgtcacctcctttcttctatgaaaatcacattttaccaatttatgattaataagtaaatatgatgtagagtcaacaaaaaaagctgacgagtggctctcatcagcttttttctatttaggaatgcgaattgttaattggatatattcctcaaattcctcttcctcggtatttattttaagcccgctgtcttctaccatatggagagactgacgaatggtattcatcgcaattcgtgtatcacgactaaacgccttacgttttggcttcggtttgcgatctgttttttgttcaagcattttcactacacgctcttcagtctgttttacattcagctgcttttcgatgatttcctgcaatagcgcgatttgtaattctggaagctttaggggtacaagtgaacgtgcatgcctttcagagatttttttctctaaaatggcctgttgtacctcttcaggcaactttaaaagtcttaatttgtttgcaacagttgattgtcccttacctaaacgctgagcaagcgcttcctgtgttaaatcatgaagctctaaaagacgtgcataggcatgagcctcttcaatagcagacagctcttctctttgcaaattttcaatcaatgccacagatgccgtttccgtatcagtaaaatcttttataatagcggggattttctcccaatgaagagtctgtaccgctctccaacgtctttcgccggcgatcagttcatattttccttcttcttctgtcggtctgacaacaataggttgaataatgccatgggtatgaatcgtcgtggccagctcatgtatcttttcttctgaaaaaatggtgcgtggctgaaaacggtttggcataattgtgtcgaccgggagctcctgtatctcttcctttaatgtatcatgctcagcaatctctgcctctatttcggtttcacgctcaggatgttctttgtcaccaagcccgaagaagcgtgagagtgaatgcttcatgaacctacaccacctttaaaaactacctttttataattctattttctcatgttttttccttctgtaaaatcttaaatattgaagaaaaaccgaccttttacatgatcaaccttctattggtgatttattaggtgttcctggttttctaggatatttttttggtgtttgctttttcttttcaatgacaatgatgttccgttcgctttcttctaaaggaagaacaaaggaatgcttttcaacaacctctcctccgaggacagtaactgctttctttcctgcttgcatttcttcatcagcagcagatgcttttaatgccacaaacaacccttccttttttacaaggggcagacatagttcgctcaagacggataaacgcgcaactgctctagcagtgacaagatcatagctttcacgcttttccttacgttgtccaaacgtctccgcacgatcatgataaaaagtagtatcttgtaagtttaacccttttgctaactcattaagaaacgtaattcgtttctgaagagaatcaacaatggtcacatgtagatgagggaagcaaattttaagaggaatgcttgggaaaccagcaccagctccaatatcgcaaatcgtcgtcactttgtgaaaatcaatgaaaaatgatgcggaaatggaatcataaaaatgctttaaatacacttcttccttttcagtaatggacgtcaaattcattttctcgttccattctacaagcatgcggaagtaagtttcaaattgttcaagctgcacaggagaaagagtcatccctttctcctctagtgctgctgtaaattgttcaatgttcatgccgacatcctttctattctgctatcttcgcaatacgtccctgctctaaatatactaaaaggatagaaatatcagcagggttaacgcctgaaatacgagaagcctgtgcaacagaaagcggtcggacttctttcagtttttgtttcgcttcagttgcaattcctttgattgcatcataatcaatacgatcaggaatctttttgttctccatctttttcagcttttcaacttgttggagtgacttttcgatataaccttcgtatttaatttgaatctctacctgctcacacacatcagaaggtagcggtgtttcagcaggagctaacttcacaactgattcatagttcatttctggacgcttcattaaatcacttgcacgaataccgtccttcagctcacttccaccaagtgaacgaataaattcttgtgtctcagctgtaggtttgatgatgactgaatatagacgttttttctctgcttcaatggcttcttttttctgctggaatgcttggaatctttcttgagatattaatccaatatgatagccaagttcagttaatcttaaatccgcattgtcatgacgaagaagcaaacgatattctgcacgggatgttaaaagacggtaaggttcatttgttccctttgtgacaagatcatcaatgagaacaccgatatatgcatcagatcggcttaaaatgacttcttctttacccaatgcttttcttcctgcattaatacctgccataattccttgacctgctgcttcctcgtagccagacgtaccattaatttggccagctgtatataatccagaaattttcttcgtctcgagtgtaggccacaactgagtaggcacaattgcatcatactcaatggcataacccgctctcatcatttgtacattttcgagccctgggatggtagaaagcatgcgctgctgtacatcctctggaagacttgtagataatccttgaacatacacttcctgcgtattacgaccttctggctctaagaaaatttgatgtctcggtttgtcattgaaacgaaccactttatcttcaatggaaggacagtatctaggaccagttcctttaatcatacctgaatacattggagaacggtgaagattctcatcaataatttgatgtgtttctaaactcgtatatgttaaccagcatggcagttggtctgttatatattcaaccgtttcataggagaacgcccgcggaacgtcatcacctggttgaatttctgttttactatagtcaatcgagtgactattcactcgaggaggtgttcctgttttaaagcgaaccaaatcgaatcctaactctgttaggtgatccgataatttgatcgatggctgctggttattaggaccacttgaatacgatagatcccctaaaataatgcggccttttaagaaagtcccagtcgttaatacaacagacttcgcacgatagttagcccctgtttgtgtaacgacacctttacattcatcatcttctacaattaaatgatccaccataccttgaagcattgtcaggttcggttcattttccattgtttttttcatttcatgctgatattggaacttgtctgcttgcgctcttaaagcacgaacagcaggtcctttccccgtattcagcatgcgcatttgaatatgcgttttatctatatttcgtgccatttctccgcccaatgcatcaatttctctaacgacaatcccttttgcaggaccgcctacggacggattacatggcataaaagcaaccatatcgaggttgatagtcaatacaagtgttttagcgccctgtcttgcagaagcaagagcagcctcaaccccagcatgaccggcacccacgacgataacgtcataattgccagcttcataacccatttcttatgttcctccctttactttcctaaacagaattgagagaataactgatcaatcaagctttcatgaacagcatctcctataatttcaccgagctgttcccagcaacgtgttaaatctatttgaacaatgtcgattggtacgtccatttcaattccttcaagagcatcctcaattgattgttttgctgcctgaagtaaggcaatatgccttgtattacttacatacgttaaatctccactttcaattgatccagtgaagaacaaagattgaatcgccatttcaagctcatcaatgcccttttcttgtaataatgatgtagtgaccaccggacgatcctttgctaactgcttgaccttttctacatcaagcttaggctcaaggtctgtcttattcacaatcacgatgatatccatacctgagacagcctcaaaaagcttaatatcttcttctgataattcttcgctataattgagcacaagtaaaatcaggtcagcttcttttaagacctgtctagatcgttcaacccctatacgctcaacaatgtcctctgtctcacgtatacccgcagtatcgactagacggagaggtacacctcttacattcacatattcctcaataacatctctcgtagttccaggaatatctgtgacaatggcctttgtttcctgtacaaggctattcagcaaggaagacttgccaacattcggccttcctataatgacagtggataagccctctcgaaggattttcccttgctgggaagtcgagagaagcgactcaatttcttttttgaccgatgtcgctttttccactaagacgcggtgtgtcatttcttccacatcgtcatactcagggtagtcaatattgacttcaatatgcgccagtgtttctaggatctcgccgcgcagtcgctgaaccaaaccggagagacgtccctccatttgagtaattgctacattcatcgctcgatccgtctttgcccgaatcaagtccatgacagcctctgcttgcgatagatctattcttccatttaagaaagcacgctttgtgaactcacctggctccgctaatcttgctccttctcttaaagcaagctgcaatactttattgaccgttacaattccgccatggcagttaatctcaataacgtcttctctcgtaaatgtttttggcgctcgaagtactgacaccatgacctcttctattacttgatcagtccttgcatccacgatatgaccataatgaatggtatgagaatccactgatacaagttttttctccttaggccctttatacatccgatcagcgatctgtaccgcctcaggcccacttaaacgaataatcgcaattgctccttcacccatcggtgtcgaaatggctgcaattgtatccatcgctcaatcacctctttctctactttaatagacagtcttttatctattaaatggacgttgtccatctctatatcaaaaacgcttaatccaaaatttaaagataccataaatgaaagcgaagtgaaagtatcctctatctaattatccacagctttgcatcctatctattttaacacttaacttatccacatgtgaataacgacgttctaaacttatcttcacatcttacaccgaaacacaataaatttaaacgccccgatgcctatgtttacttgtaaaaatggcattttccactcaaattacaccctaactttttagaaataaaggatgaatcttctatagaaacacaatttttcaataaaaaaagactaaaatccagctttgctgaattctagtctttctgttattttttatacagcaccactacatgacgcttactgcctgtatcttccgatgccgttgctagttctttagaaaaagtagcaatcgtatcatgaattacttttcgttcgttcgaaggcattggttcaaaatgaacctttctcttcgtttttaaaactttgtttgccatcttgacggcatattgttcaagtgcttcttgtcgcttcttcctataatctccaatatcgatggtaatatgatgatactgatcagaatagcgattaaacactagctgtaccaaggtttctaaagagtacaaagtttgtcctctttttccaatcattaatgacgttttatctccatcaatgtggaaagaaatctttttcggtccctgtttggaaataattttcgctttaggatcaattgatttaacaatattatctaaatactgtgtagctaatttaagagcatttctcttttctatcaacttgactacagcttgtcttttgccaaataatcctaagaaccctttatttccttcatccacaattgtgatatctacttcttcttttagaagctgaatttgcttaagtccggaatctactgcttcttcgattgtgcgaccgacagcagttacttccttcattttttattcccgccagctttttcttttgtatctaattttacttgaggagttttaatcactaatgtttggatgatcatgaaaatgttacctacaacccagtacaatgaaagtgctgctgggaaactaatagcaaatacaatgatcataatcggcataacccataacatgatcgccatctgagggttgtccgaaggatttccagccatcatcagtttttgctgaatgaaagtagctacccccgcaatgatcggtaataggaacaatggatctggactgcctaagtcaaaccataagaatgtatgctttttaatttctgctgttctcataatcgcatgataaaaaccgattaggattggcatctgaattaaaatcgggaaacagccagctaatggattgacgccatttttttggaaaagggccattgtttcctgctgtagctgctgctgagttttttgatctttagagctatatttttcacgaagctttttcaattcaggctgcaatgcttgcattgcttttgtacttcttaactgcttaatcattaatggtaaaatgagcaagcggattaacaatgtcacaataatgatcgcaaccccgtagttttcaccagtcaaatttgccatgtacgtgattaattgagatagcggataaacaatataagagttccagaatcccttactatctgatgtgattggttcattaatttgtgtacatcctgccaatagaaccaatgcgccaatcaagctaaatattagtaataatcgccttttcaacaagattcctcccattacttcaaactttatttaagttggaattgattacgaaagtgactcacctaatcagtatggtaacattttttcattacaaagtggtggtttcattttaattcactagatgaaggaagcgcttttaaaaattgattcaacgaaagtttctattacgaagactttttcggttgttgttgataaacagcggattttctaaataaatgttggagagatttctttgtttcttcaaaggtcaattcacttgctggttttcttgcaatgacaatgtagtctttttcttgctttaacttatgaccttcctctaaaaacacctggcggatcagtcgtttaattcgatttctcatcactgcattacctatcttcttactgacagacaatcctaaacgcagttcatcttgatttggttgatccagctggtaaataacgaattgacgattcgccattgattgaccttttttaaacactttttgaaactcttcatttttttttagcctgtttcgcttcttcatgttttcttccactccgataaaaactgacagttcatttacgattttatgtaaaaaagaccactgacattattcagtggcctaagctgataatttttttctacctttgctgcggcgtcgctttaaaactagacgtccgttcttagaactcatacggctgcggaagccatgaactttactacgcttacggttatttggttgaaacgttcttttcatttatgacacctccctgaggaatagctgtttaagacagtctaactcattatatttgtgtaacccatcgattgtcaatatcaacgataaaactcttattatcaaccttataagcataacataatttatcaaacgaagaaaccttctttttttgtttctaacattttattctctttttcctcctaaaaggcctccaaaacaagggtgtggatatttttccggcatatttagactatccacattcattatcgacatttttttcacacaaataaccgatgtggataattaattttcaacaggatgtaaagtgtgtggataagtttgtgacacccattgcgccatcgtgtttattttgatattatatttgtgttttaactcttaattaattatctgacctatttatgttatccacaaactgtggacaacctgtggaaagatattacacagcttgttgaattgtttatccacagactgtgtaatttgtcgaaaagacgtttttctactatattatttgttttcaacaatgtatgtgcacgaatggtaatgaccatttgctctttttcgtgttctataacagtttgatactggtcattttaaaaagaaaaggaggggggagaagccttatggaaaatattttggatctgtggaataaagcacttcaaaaaatagagacaaagttgagcaaacctagttttgagacatggatgaaatcgacaaaagcccattctcttcaaggtgatacgctcacaattacggcacctaatgaatttgctagagactggctcgaatcaagatatctccacttaattgctgataccatctacgaactgacaggtgaagagctcagcattaaatttattattcctcaaaatcaagatgaagtggaagctatgccaaagtctccaattaaaaaaatatctaaagaagatcccgtcgatattccacaaaatatgctgaatccaaaatatacatttgatacttttgttattggttcaggcaaccgatttgcgcatgccgcttcacttgctgttgcggaagcaccagcaaaagcatataatccgctctttatttatgggggcgttggtttaggaaagactcacttgatgcatgcgattggtcattatgtcatcgaccataatccatcagccaaagtggtctatctatcatctgaaaaatttacaaatgaatttatcaactcaattcgagacaacaaagctgtcgatttccgtaatcgctatcggaatgtcgatgtgcttttgatagatgatattcaatttttagcaggaaaagaacaaacacaagaagagtttttccatacattcaacacacttcacgaagaaagtaagcaaatcgtcatttctagtgaccggccgccgaaagaaattccgacacttgaagacagattacgctctcgatttgaatggggcctaatcacagacattaccccgccagatttagaaacgcgtattgcgattttacgaaaaaaggcaaaagcagagggcttagacattccgaatgaagtcatgctttatattgccaatcaaatcgacagcaacattcgtgaactggagggtgcgttgattcgtgtcgttgcttactcttctttaattaataaagacatcaatgcggatctagcagctgaggcgctaaaggacatcattccttcatcgaagccaagggtcattacaattaaagatattcaaagaattgtagggcagcaatttaatattcgtttagaggatttcaaagcgaagaaacgtacaaagtcagttgcttatccaagacaaattgccatgtatctctctagagaaatgaccgattcctctctgcctaaaataggagaagaatttggaggtcgtgatcatacgactgtcattcatgctcatgagaagatttcgaaattaatggttgaggatgaacagcttcagcagcatgtgaaagaaatcaaagaacaattaaaataacctggctgatataataagtacgggaaaatgtgaataactagaacatagtcatacacagtctgtccacatgtggataggctgtctttcctttctttttaccgacttatccacatattcacaagccctactattacttctacgatttttattaataaaatatatatacatgtcattaagaaaatttaggaggaccactatgaaattcacgatacaaaaagatcgtcttgtcgaaagtgtccaagatgtattaaaggccgtatcctctagaacaacgatccctattttgacagggatcaaaattgttgcatctgatgagggggtttctctcacaggaagcgactctgatatctcaattgaatcctttattcctcaaagagatggagatttagaagtaatcacgattgatcgtccagggagtattgtgcttcaggcccgcttctttagtgaaattgtgaagaaactgccaatggctactgtcgaaattgaagtagaacaaaatcacctcaccatcatccgttctggttcagcggaatttaacttaaacggtctagatgctgaggaatatccacatcttccgcaaatcgaagagcatcatgcatttcaaattccgacagatctacttaaaaacttaattcgtcaaaccgtttttgcagtgtccacctcagaaacacgtcctatcttgacaggtgtaaactggaaggtggaaaaaggtgaattaatatgcacagcgacggatagtcaccgtcttgctttaagaaaagcgaagctggatattgacgaggaaagctcatacaatgtcgtcattccagggaagagcttaacagaactaagtagaatccttgatgacggacaagatcttgtgagcatcgtgattacagaaacgcaagttctctttaaagcacaaaacgtgttgttcttctcaagattgctggatggtaattatccagatacagctcgcctgatcccgcaagaaagtaaaacagatgttgtggtcaacacgaaggaattccttcaagctattgatcgtgcatcacttttggcaagagagggacgtaataatgttgtaaagctgtcagctgatcctgaacaaagccttgagatttcttctaattcacctgaaattggtaaagtagtcgaaacggttcaagcagatgatattaaaggggaggacctcaaaatctcctttagtccaaaatatatgctagatgcgttaaaagtattagagggaacagaaattcatgtaagtttcactggtgccatgagaccgttcctgttgcgcacaccaaatgatgattcaatcttgcagttgattcttccagtcagaacatattaattcaatctaaaatagctgctgtgtgagtgcacagcagcttttcttctcgtttaccatgctttctttcatcccagttcgctttccccctttccttcttgtcttgttttttagtacaattagatattagtgatattgaaagaggtcgatacaatgcctaatcctataaccattgagaaagaaatgattacattagggcaatttttgaaattagccgaagtcatccaatctggcggaatggcgaaatggtttttaagtgaacatgaggtgttcattaatcaagagccagataatagacggggacgcaaactatacccaggagatgttgtcgagatagaaggttatggcacatttcaagttgtgaattagaaacgggtgacaatacatgtacattcaaagtctggcgttaacttcataccgaaactatgaacacaccgagcttcaattcgacaacaaggtgaatgtcatgatcggtgagaatgcccaaggtaaaacgaacttgatggaagcaatctatgtattgtcgatggcaaagtcgcatcgtacgtcaaatgataaagaacttatccgatgggaccaagactatgctaaaatagaaggtagagtcattaaaaaaaatggtccactcccaatgcagctcgtgatctccaaaaaagggaaaaagggcaaggtcaatcacattgaacaacagaagctcagtcattatgttggtgcgctaaacaccatcatgtttgcaccagaggacttaagtcttgtaaagggcagcccgcaaatccgcagaagattcctcgatatggagattggacaagtttctgctgtctacttgcatgatttatcgctctatcaaaaaattctctctcagcggaatcattacttgaaacaactgcagacaagaaagcaaacggatcaagcgatgctggaggttttaacagagcagttgattgatgcggcagcgaaggttgtcaaaagacgactgacttttacgaaacagctcgaaaaatgggcgcagccgttgcattttggcatatctagagagctagaaacactcacgctccaataccaaacggcgatagaggtatcagaagcgtcagacttgtcgaaaataaagaatagctatgaagaatcgtttcagaaactaagagacagagaaatagaccgaggagtgacgttgtggggacctcacagagatgaccttcttttctttgtgaatggtcgggatgttcagacatatggctctcaagggcagcaaagaacaacagctctttcactaaagctggcagaaatcgacttgatacacgaagaaatcggagaatatcccattcttctactcgatgatgttttatctgaacttgatgattacagacagtctcatttgctccataccattcagggacgtgtacagaccttcgtcaccacaacaagtgttgaaggcatcgatcacgccaccttgaaagaagcggaaattttcagagtagccagtgggaaagtaattgactgataaatgaggtgtgggtcttgtatattcatttaggtgatgattgtgttgtttctacacgagagattgtcgcaattgttgattacaaaatgaggtcgtcttctgttgtagaagagtttcttcaaaaacaagaaggacaaatcatttcgttatcacatgggacacccaaatccatcgtcgtcacaactaaatctgtttattactctcctctttcctcaagcacgctcaaaaaacgtgcttcatttgtgattgaaattgaagtctaaaagctcaattcatataaatatatcgtttaagaaaagtgtaggtgaatgtacgtggcaatggaacagcaacataatagttatgatgaaaatcagatacaggtgcttgaaggactagaagctgttagaaaacgtccaggaatgtacattgggtcaaccagtgcaaaaggacttcaccatcttgtatgggaaattgtcgacaacagtattgatgaggctttagctgggtattgcacagatattacggtgcaaattgaaaaggataatagcattacagtgaaagataatggccgcggaattcctgttgggattcatgagaaaatgggacgtcctgctgtagaggttattatgactgttcttcacgctggcggtaaatttgacggcagcggttataaagtatctggcggtctgcatggcgtaggggcatctgttgttaatgcgttatctacgaccttagacgtgaccgtatatcgtgatgggaaaattcattatcaacaattcaaacgcggtgttccagctggagatttagagatcattggtgaaacagatgttacagggacaaccactcattttgtgccagatccagaaatttttactgaaaccattgaatttgattacgacacacttgctaaccgtgtacgtgagttagctttcttaacaaaaggtgtaaacatcattattgaagatttacgcgaaggtaaagaacgacgaaatgaatactgctacgaaggcggtattaagagctatgtagaacatttaaatcgctcaaaagaagtcgttcatgaagaacctgtttacatcgaaggtgaaaaagacggaatcacggttgaagtggcattacaatataacgattcctatacaagcaacatctattccttcgccaacaatatcaacacgtatgaaggcggaacacacgaagcgggctttaaaacaggtctgacgcgtgtcatcaatgattatgctcgaaaaaatggcgtattcaaagatggagactcgaatttgagcggtgaagatgtgcgagaaggcttaacagccattatctctatcaaacatccagatcctcaattcgaaggacaaacgaagacaaagcttgggaactcagaagcaagaaccattactgactcccttttctctgaagcacttgagaaattcctcttagagaaccctgattctgcaaagaaaattgtggaaaaaggcgtgatggcagctcgtgcaagaatggctgccaaaaaggcacgtgagctgacaagacgtaaaagtgcactggaagtctccagcttaccggggaaactagcggactgttcttctaaagacccttccatctctgaactctatatcgtagagggagattctgcgggtggatctgctaagcaaggtcgtgatcgtcacttccaagcaatcttaccgttaagagggaagatcctaaacgttgaaaaagcgcgactagataaaattctatcgaacaacgaggttcgttcaatgattacagcgttaggaactggaatcggagaagacttcaatttagagaaagctcgctatcacaaagttgtgattatgaccgatgccgatgtggatggagcgcacattcgaacgctgcttttaacattcttctatcgctacatgcgtgaaatcattgaaaacggttatgtgtatattgcacagccgcctttatataaagtgcagcaaggaaaacgtgttgagtacgtgtataacgataaacagctagacgagctgttgaaatcactttctcaaacaccaaaacctggacttcagcgttataaaggtcttggagaaatgaatgcttctcagctttgggaaacaacaatggatccggatgcgagaacacttcttcaagtgacacttgaggatgcaatcgatgctgatgagacatttgaaatgctcatgggagataaagtagagccgagaagaaactttatcgaagaaaatgcgcaatacgtgaaaaacctcgatatttagatccctactgagaacaaccttatttcttgtttggaataaggttgtttttcaagaaataggggcgtgtaaccaatgtcctgtttttccgtgttttcgttgattttctagtaaataaatgtgtataaagacgagattattgatataatggagaatagtcttgtgaagataaatacatattttactcccacataatttatttcatgtgatacgtaaagggaggttcttatagtgagtgaacaacatacaccaaatgtacgcgaagtgaatattagtcaggaaatgcgtacgtcttttttagattatgcaatgagtgtgattgtgtcgcgtgcattaccagatgtgcgtgacggattaaagcccgtgcatcgaagaattttgtatgcgatgaatgacctaggtatgacaagtgataaaccatttaagaaatctgcacgtattgtcggggaagttatcggtaagtatcaccctcatggtgacagtgctgtatacgaagcgatggttcgtatggcgcaagacttcaactatcgttatatgttagtagatggtcatggaaactttggttcagtcgatggagacggagcagcggcgatgcgttacaccgaggcacgtttatcgaagatttctatggaaatcctccgcgatatcaccaaggataccattgattatcaggataactatgacggcagtgaaagagagccaatggtgatgcctgcaagattcccgaacttgttggtcaacggagcgacaggaattgctgtaggcatggcgaccaatattccaccgcaccaactaggtgaagtgattgatggggtattggctatcagtcaaaacccggaaatgaccacacaggagcttatggatatcattccaggtccagatttcccaacagcaggtcaaatcattggtcgaagtggtattcgaaaggcgtatgaaacagggcgcggctctattacattaagagcaaaatcgaatattgaggaaacatctagtggtaaacagcgcattgttatcaatgagattccttaccaagtcaacaaagcccgtttaattgaaaaaattgctgatcttgtacgtgataaaaagattgatggcattacagatttgcgtgatgaatcagaccgtaatggtatgcgtattgtcattgaactgcgtagagatgcaaacgtccatgttctattaaacaatctttataaacaaacgacacttcaaacgtcatttggtatcaacttattagcacttgttgatggacagccgaaagtcttgtccctcaaacaatgtcttgagtattatctagagcatcaaaaagtgatcattcgcagaagaacagcgtatgagctgcgtaaagcagaagcaagagcacacattttagaaggtctgagaattgcacttgatcacttagatgaagtcattgctttaattagaagctctcaaactgcggaaatcgcaagaaatggtttgatggaaaactatagcttgtctgaaaaacaagcacaggccattcttgatatgcgacttcagcgtttgactggtctagaacgagaaaagatagaagatgaatataaaggacttgttgatttgattgctgaattaaaagccattttagcagacaatgagaaagtacttgaaatcataagagaagaattaacagaaattaaagaacgcttcaatgatacgcgccgtactgaaattgtgacagcgggcattgaaacaattgaagacgaagatttgattcctgtcgagaacatcgtgattacgctgacgcataatggttatatcaagcgtctcccagcgtctacataccgcagtcaaaaaagaggcggtaaaggtgtccaaggaatgggaaccaacgaagatgatttcgttgaacagttgatttcaacatcgacccacgatacgattcttttcttctctaataaagggaaggtttatcgtgcgaaagggtacgagattcctgaattcggacggacagcgaaagggattccgatcattaaccttcttgaagtagaaaagggagaatggattaacgccattattcctgtaagcgaatttgatgaaaattcgtatctcttctttacaacaagacacggtgtatcaaaacggacgacattgtctcagttcgctaacattcgaaacaacggtcttattgcacttagccttcgtgacgaggatgaactgatggctgttcgtttaaccaatggagaaaaacaaatcatcattggaacgaaaaagggaatgctgatccgttttgacgagacagatgttcgtgaaatgggacgtacggcagctggagtgaaagggatcacactttccgaagatgacattgtcgtaggtatggaaatccttgagccagatgcaaacgtattgattgtaactgaaaaaggatatggcaaactaacccctgaaaaagaataccgtgttcaaagtcgtggcggtaaaggtcttaaaacgtgcaaaatcactgacaataacggcccacttgtcacagtgaaagcaactaatgctgaagccgaagaagacttgatgattattacaggaagcggtgtaatcattcgtatggccgtttctgacatttcgacaacaggtcgagtcactcaaggtgttcgcctaatccgtctcggtgatgaggaacatgtcgcaacagtggcattagttgaacaatcacaagaagacgatgaagatgatgaagagaacgtagaaaatatagagtcagatcaagagcaatctgagtaaaaataaagccggttctacaccggctttattttttttgaaaaaacaccattttttttgaaatttataatgcttttttcatagatatgtgttaatctttcaaaggagcaaaaagaggctctattttttatctcattccccagtaaaaacttcttagaaaaacaaaatgttttttaagaaaaatgttgactgttgatagagatatatgatatatttaagtggtcgctttaagagagtgacacaactggggctactggatccacagggatcactggtgcaaccgggcctactggagctacgggaattacaggacctactggcgttacaggtgttactggggctactggaacaggtggttttacggatacagcactttatgctgctaatagttctggtcctaccattgttactgtagccgggggaaccaatattcccttaccaaactttcaaaatattactggttttacagcaaacggcacaagtactgttttcaccgttccacaaactggtaaatattatattacgtatcaagtcaacaccactacagcacttttgattaatacacgtttgcttttaaatggaacaactacaatttctggttcagttcaatcacctgttatttctacttcatttatcaacaatacagttattgtcaatttaacagcaggaaatacgatttcattacaatttttcggtgcggttgtaacagctattctagtaggtggtggtgcaaccggtgcatcgcttaccatcatcagactcagctaagtaaaactaagataaaaaaaagaaaggctcagtcggcctttctttttttatcttcaataacgcttatacaatgttcaatatcatcagattgcaagagatgaaaaacagactgtatgattgaaaactctaaattccaccattctaacaactgaagtttttcaatgatatcagaagaaaaccgatatttcatgagccgctgcgggttccctgctacaatcgcatatggtggcacatcttttgtaatcagactatttgctccaatgactgccccatttcctatatgtactcctgacatgatcgttgctccatatccaatccaaacatcgtgccctatgcacacatctccttttgatcgtggatgtccttcaatatgagcagcctctgtgaaaatttgattaaagggatacgtcgtgacccaatctgttcgatgttcaccaccaagaaaaacttttacttcgtttgcaatggaacaaaactttcccactttcagtgtcgttccttctccccaagtcaacacttgaaaatctggtccggcataagtgaaatcaccgatatcatacgagccgagctcacttctttggtttaaaaacatagaagatcagaccccctaaaaagtaatcgatcttcgtatgtatatgcccgatgataggctcacattatgattggacaagtgcaacgatctgctttttcttccaaaccaatcgataatagccatattggaggaataagtttacaaaaaaggctgcaggatatcctatccagattcctttgatcccgagcgatgtgtggtgtgatagcacataagccactggtacttcaacaagccaaatggaacaaatactaaagatggtcggccatagaacggttccacttgctctcattgtggctgcaacgatttgcgccgttccaaaaatgagatagctccatagtgtaatcacgaccaaactatatgcaatatcaatcgttgcaggatctgttaaaaagatagataaaatttgcggtgcgaaaatatagacgaaaataataatcaatccgcctatcgcaaagtttagccctagaccaattttaatgacatctttcaaacgattcatgtttcctgcgccaatgaattgtgctgcgaaaatagaaaccgcaataccaaggctcactgcgggcatctgtacataacttacgacttggttgacaacgccataggctgctgttgcctgtgatccataatcgtttacaaaagaaatgacagcaatttctgataaagaaatcagaatcatattaatactagaagggatacttaactttaataacgtttttaataaatcccctttcatcaataaatgctttctaaccgacgcatcaatgcgcagcggatgctttgttttataaagatagatatgcagaatgataaacgtaacgattgtagaaatcactgaagaatacgcagcaccatataaaccaaatgccggtagaccgagccagccaaataataaaatcggcagcaataaaatatttgttccagtactaatcattaagaaataaaatggtgtttttgaatctcctgttccacgtaaaaaggtcgtatagacaaaataaagaaataagaccggcatggagatgaataggattctggcatatgccgcactttcctccacaatatttgcaggtgtccccatcaaatgtaaaatatcagttgcaaaaaagcctccaatgacagctaaagaaagtccaattaaaaaagtgaacgaaagcgttgtgcctataatttcctttaatctctgctcattttttgctccatacgcttgtccaatgaggatcgagcttcctgatccaattccaatggaaaaagaaacaagtaaaaagaaaagcggaaagaatgcagaaattgcagctactgcatcctctccaatccatctaccgacaagcaaaatggacacaagctgcccgattgattgtaaaatattgcttaataaaagtggaattagaaagatcgacatggtttttactaaagattgattattatctaacgtcatgatggttctccttctctgtctaaagatcctcagctaatatgctgacaatgcggtcttctatctctttacctttttcgtcatcaacgaggtgattcaataatatggaaaaagcaagcgtctttccactctgcgtttcaatatacccagatagtgtactgaccgttgataacgagcctgtttttgcacgcactttttctagtgtagctggttctttcaatctgtttcttaatgtacctcccaccatacgctcacttgccccagctaacggaagtgcattgacataggtgtcaaaccatttttccttttgaatgtttgtcaaaaataacgtgaattggtttgctgaaacaagattaatgggtgatatgcctgatccgtctctcaacacagccatggatgaatctatgccaaaggcagggagacgttcattcagcacgtcaagccctttgtcaaaacttcctttgttctttacccgcttgccaagttcttttaacagaatttctgcatgtgtattattgcttaatttcatcatcggaacaagaagctccgataaaggcattgacgaatgggaagcgattttttttgcttttttaggaacttgttttgttttgagtgatcctttcagctgaataccctcagcctttaatgctcttttcattaagtctaaagaatacgttgtcggttcccataatgctacccattgtttagatgaagatgcttttagcggaatcgtcccagtcagcgtaattttgtttgtgccgtgagagcgcttaaaagatatttttttctttccgccttctggcacagttttcacttgattgacaacttgagcgacgtcagtcttcgggatcgtgtcataggtggccttctgccctgctttctttcctggcttgacttcgagaatcagcgttcctgcatcataatcctcattcggtgaagcagtgagagcagatatttgagcgccgtaatattgatcttcatcactccaaggtaaatcaatcgaataccttgtgtcatcaaaccaagtatcatcagccgcaagctgtccgcgaattgtatgtattccggcctttttcacttgtttggcaagtgctgcaaaatcctcttctaataaagtcggatctccggtaccacgtagatacaggcttccatataacgttttcttttgaatagaaccatccatccagatgtctgtagggaatgtgtgtgtttctccaagtatatcaagggcgatagctgatgtgagcagttttatattagaagcaggagtaaggcgcgtatcggcttgatgttcataaagaagagaggagtcagaagtatcgcggacgctgatgccagagattgcactttctaaatcaggtgctgttcgtataaattcatctaaagctgtcatccacggcagtgagccgttacgagctacaagttgatcatcttttgctgaaaacgggagaaataaaatcgacaggatacatatttgtaaaaacaagagctgtgaaaaacgcttcacggaatccctccttttttgtcgcagccaattttagaagaatatgttcattatacacaaaagaacgtttgttctcaaaggttttttaaacagaaaagtcagctttctttgacgaaaactgacaagccctttaccttttttctggattccagccatcggctccgccaagaacagcttgcaccgtgatttgacttgcttcgtttttcgttaaaatgctggaccattttacgcggtttgtcaaattgcttcctgcccctgccgatccatattctttatatcttgctgttctttcgttatcacggttatcccagttatgccatccctctgcctttatatgatcatccatttgtgtatagaggaatgtcacagcagaatgaggccgccacggacgtcctaaataaaccgattgagcagcagccgtccccttttgcaatgtagagtcgatgaatacatagccatacttttgagcttcagttgtggatgctgcagtaatatacccatttccaagacttcttatttcagctcttttaaacacagctgtggctgatccaaaaataaaatcgaccgttccttcgatatagcagttttcataatattggcggcctgttcctgttgcataaagtgtatcttgataccctaagactcttatttgtttgaacgcagcccggtcgccagagacgtacagtgcaactgcctgaccagcatgtctgccggccgtattttgaaaggtgatattttctgcgtaaaagtcgttcgcacgaatcattgtgcttgagctatttgttgtgctgccagtacttgcatttgtatcattatacgttagaatcgtcttgtgttggttttccccgataaaggacacataaggtttattttgcggaagcaggattttttctttatacacaccatttttaatatagatcgttacgcgctgttgattgttcactggaatcgcatcaatggcagactgaacgtttcgaaacgagccatttcccttttgatcgaccacaaggacgcgatttgtttgattctgatgtacggctgcttgaagtgaagctgagttcaatagtaataatgacaagactgccacaagccatacctttccatacttcatcatacatttcctcctctttgtgaacgttttcaatcaaacattctttttgatcctattcatgataatcacaaaaaaacacccccttattgatgttatgggtgttttttagacttttcatatttcatcgcataaatcccttcattttcaatccattcacaaaatagaacgtctcgataagaagaaatatgcttcttttttaattgctctctcagccatgtttcatcgaaaccagcttcttgtaaatctttttttaaaatttcaccatcaataataaacgttctaggcaatttgacttcttttcccttcacgttcacatcttctgcggtggctgttgcgtatttcattttcggaagaacgctcaccgatccatctgtttccaaaatggcatattcaatttcattcagggcaaaatgacctttcgcgcgaattaatgtctgcagctgattgagatcaagcatatttttctttaaacgattgtagtgaattttcccttgatcaatgacaagtgtcggtctcccctctaaaaaagctcgaattcctttaaagcgctgtgaaaaccattcaacagtgtagatgaggacaccccataccgcaacagcaaataaaatgtgctgaattttgacttctgggtcaaaaatggcgtttccgaccatttcccctaaaattagtgcagaaataaaatcaaacggcgtaatttgtgcaaattgtgttttccctaataattttgtaattaaaaacaatgcggaaaacccgataaagagctcgatcaaaatactaagaaacggcacgaagattccttcctttcttgctctatttacatacagcatatacatgaaaggaaggttctaaacgacttatgaggtcaataaaacaaagacctcgttcccctcaaccaatgtttcatatgtttgaacgcatccatgatctggtgcttgaacattccctgatgaaagttcgattttccaatcatgcattggacagaagacatgatccccgctgaccattccttcagctagtacaccgcctttatgaggacagcgattttcaatggctttgaactgctgattagaggtttgaaaaacagctaattcaagagtacctgctgcaactgtttttcctagctgcagcggaaaatctgataaggtgccaatgtgaacttttacaactgaaactgtcatatgatcccatcccttcaattgattgatacagaagccgtcgctttttgaaataattgtttcgaatctttttgactcccgcgaagctcctgccaaggctcttcatatgttgaaagtgcgatgtccattctttcgatcaaggcttctcgtttctcatcatctagaagtactgattgaatatgatctaatcctagtcgttcaacccaagcagaggttctttctaaataatttgccgtttctctgtaatattgaagatatgcagctgccacttcctctacttcttcagctgtactgaccttcatcaataaatcgccagcccgcaggtgcgtgccgccatttccaccagcgtacaattcgaatcctccatcaattcccacaatgccgaggtccttaatgccagactctgcacaatttctagggcaagcagagacagccaatttgactttatgcggtgtcgcaagaccttcgaatttcttttcaagtgcaatgccaagagccattgagtcctgtgtgccgaaccggcaaaattgttctccaacacaagttttgaccgttcttaaagattttccatatgcataaccagaaggcatatccaggtctgcccacaccttaggtaaatcttcttttttgacacctagaaggtcaatacgctgaccgccagtcattttcacaagcggtatttcatatttgtcgacgacatcagctatttttctcaggtcatttgcatttgtgacgccaccgtacatcctcggaacaactgaataagtgccatctttttgaatattggcatgcaagcgttcattcacaaatcttgagctcctttcatctttgtactcaagaggttgaagcatgcctaaatagtagttcagggcaggtcggcattttgaacagccctcttctgtctcccagtcaagtacgctcatgacttccttgatatgctgcaagcccttctctttgatttcgtgaatgacctcatctcgtgaaagagtggtgcaggcgcaaatggtttctttttgagctgttcggttcgcaccctcgcccaacgtgtgccaaagaatctcttcgacaacgggtttacagcctccgcatgatcgtgaggcacttgtacattgcttgacttcctgaagcgttgttaaaccttctttttgaatggcttccacaatctgaccctttgagaccccattacagccgcaaacgatatggtcgtttgacatgcttttaatcgtgctttcttgcgccgaatcatttgaggttaggacagataccttctccatatccgacatatctaccccttctctaatgtacgaaaataggcgggggccatcatttgtttctccaaacatgacggcaccaactaaacggttttgctggaagactagtttttggtaaatgcctttttgttcatcaaaaattttgatcgcttttttctcattgttttcaataaaatcaccagcagaaaatacatctactcctgacactttcagctgtgttgacatcacagaaccttcatatggggcaggattcatgccacatatatgaccagcaagcacattcgcttgatcgtataaaggagcaacaagaccgtacgtttgtcccctgtgttctgcacattctccgactgcataaatgcccggtacacttgtttccatgaaatcattgacgataatgccttggttcacttcaagaccgcttatttctgcaagcattttacttggtttaattcctacagccatgacgacgagatctgtctcaagtgttgtgccatctgaaaataataatccttcaactcttgtatctcctaaaatctcagttgtctgttttcctaataggaagttcatgccctgttcctctaatgctttttggagaagctgacctgcagtagggtctagctggcgttccattaaatgagagcagaggtgaatgacattcacttccatgcctaagttaagtagaccgcgtgccgcttccagtccaagaagcccgcccccaatgactgctgcttttttgtacatgtgagagacattgaccatttcctctgtatcttgcaatgtccgaaaacctgtcacaccttttttatcacttcctggaatcggcaaaataaacggaagtgacccagttgctaaaatcaaccggtcataaggcacggtccgtccttgatcactggtgactgtttgattttctgtatcgatcttcacaatggtttcatttgtaaaaagctgaatatgatgcgccttataccatttccaatcatttagtgtaatatcttcaatcttcgtatctccttgaagcaccttcgataaaagaatccggttatagttgggatgcggttcgcttccaaataccgtcatctcaaatcgttcgctgtcaatttttaaaatgttttcgaggcttcgaataccagccataccgttccccactaatacgagtctttctttcatgataaaacacccctcatgtgatcatttttagaaagtaccatcatttaaacatagattttaaatacatgtttttaattctcgcatactctggcggctgtacaggactgttcccttgctaccttttttcatgttgtgtgacgacggcaaattttgctcaacgatcataatgtgagcattcatttttaaatcatcgttcgtttcataggtcatgccagaatcatcagattcttcatcttatgacggttcacatttcctcttctgcgggagaaaaagccgtatttgtcttcatatagttgctaaacacaaatgatttgccaatcgtactttctttgggtgaaatgttgctactttaagcgtaacgcgcccttctgcgtttgtcacggtacgttcagcctttaaatatgacgaagtaagtaaaattacatcttctgaatcataaaaagccatgaccactagttggtcatggcttttctttatatgtgtaaacaccctttgtttgacctattttggcagaaccgaactccccattaaataacggtctacctcgtgcgccacttgtctgccttcattaattgcccagacaatcaagctttgcccgcgtcttgcatctcccgctgcaaatacgccttctacatttgttgtatactccccatactttgcgtcaatgcgattgtttttgctgtccacgccaaagtgtttcacgagtggctgttcagttccctcaaaaccaattgcaataaagactagctgagccggccatactttttctgtccctggaatctcatgaaattcaaacttcccatgttcgtttttcaccttttccatttgaatcgtatgaagctcttttaattttccctttttatctgccaccatttttgtggtttgaatggaatattgacgcggatcttccccgaacttagcttgtgcttcttcataagcataatcgagtgaaaagacgtaaggctgttcaggccacatgttatcccctacacgtgtatccggaagctttggatgctttccgaattgaacaacactttttgctttttggcgaagtgcagttgcgacgcagtcagcgcctgtatctcctccgccaataacaatcacgtctttaccttttgcgtcaataaagtttttatctttaaatcctgaatcaagcatgctttttgttgcaagtgttaaataatccattgccagatgaatcccttttgcttctctgccttcaattaacaggtcacgctgtttttgtgcacctgtacaaaggatgaccgcatcaaactgttctttcagttcatcggcagtgacatccacgccgatttctgtgttcgttacaaaatcaatgccttcttgtcttagcagtttgactctgcgctcaacgacttctttgtccagcttcatgtttggaatgccgtatgtcagcagtccgccaaggcggtcagaccgttcaaacactgtaacggcatgacctgcttggtttaattgatcagcacttgcaagtcctgctggtcctgatccgacaatggcgatctttttccctgtacggtttgaaggaattcttggtgtaatccagccattttcaaagcctttatcaatgatcgtgcgttcgatatttttaatcgaaacagctggatcattgatcgcgactgtacatgacccttcacaaggcgctggacatactctcccagtaaattcagggaaattgttcgttttttgtagtctttcaagcgcttctttccatctcccgcgatagacaagatcgttccattctggaattaaattgtagatcgggcagccagaaacgccgcctctgatctccatcccaatttgacaaaacggtgttccgcaatccatacatctagcaccctgctgttttaatacctcatctgtataaggagctgaatattctttccagtcattttgacgagtgagagggtcacgttcatttggcttttctcttttataatccataaaacctgttgctttgcccattgtcctctcccctttcttaatgagcgagggctgctttttgcccgtttgccgtttcttgatttttcggttttgtgtttgcttcaaatgcgaacataacagcttcttcatgactaaggcccgcttgtttttgttcttcaatactttgaagcatcattttgtaatttctcggaatgaccttgatgaattgttccttttcttgcgcccagttttctaaaagtgccgaagcttttgcgctgtttgtatagtgaaggtgctctttaatcagctgttttacttcttgctcttcatcgtgatctgtgagtttttcaaacatgatcatttccatgttgcacattcttttgaactgtttcgcatcggatgtatggacgtaagctacgccgccagacatgcctgcaccgaagttttttccgacgtctcctaaaatgacgacacgcccgcctgtcatgtattcacagccgtgatcaccgattccttcaacgaccacatgcacccctgaattacgaacggcaaagcgttcacctgcacgtccgttaataaaggcttttccgcttgtcgctccgtagaatgcgacgtttccgacaatgacgttttcatgtccattttgtaaaaagtgatcagaggttttaaccgcaattttgcctccagagagtcctttgccgatataatcatttgaatcacctgttaaataaagagacatgccctttggtacaaatgcgccgaagctttgtcctgcggaaccagtgaaccttagtgtgatcgtatcctctggcaagccttcttctccgtagcgcttagacacttcacttccagtaatggttcccgccacacgattgatattgcgaatattcaatgatagatcaaccggtgtttgatgattcagcgcttcctgtacataagggagaatttcattcatatccagtgattcatcaattttatgattttgcggtgttctgaatgtacgagctccttctggctgataaagcagtgtttcaaggtctagctgacctgctttccagtgtgcttttgctctttcactcacggataaaacatccgtacgcccaatcaattcatccattgatgtaaagccaagttcagctaaaatctctcttacttcctctgcaataaacatcatgaagttgacaatgtgatcaggattacccataaattttttgcgaagttcagggttttgagttgcgacaccgactgggcaagtatctaagtggcatgctctcatcatgacgcaccctaaaacaacaagtggagctgtcgcaaagccgtattcttctgctcctaaaatcgcagccatgacaacatcgcgtcctgtcattaatttgccatctgtctcaagaacgactcgctctcgaagaccgtttaatacaagggtttgatgcgcttctgccaatccaagctcccaaggaagtcctgtatgtttaatacttgttttcggcgaagctcctgttccgccgtcgtatccactgattacaatgacatccgccgtcccttttgcaacacctgctgcaatcgtaccgacgcctgcttttgacacaagcttgacgctgatgcgggcatcacggttggcgtttttcaaatcatggatcagctgcgccaaatcctcgatggaataaatatcatgatgaggcggtggtgaaatcaatccgacgcctggagtagatccgcgtacatcggcaacccaagggtatactttattacctggcagctgtccgccttctccaggttttgctccctgcgccattttaatttgcagttcatctgcattgaccaaataatggctctttacgccaaagcgtccagaagcaatttgtttaatcgcacttctgcgatcatcgccgtgctcgtcaactgtaaagcgtgcaggatcttctccgccttctccgctgttacttttaccgccaattcggttcatggcaatcgcaagtgcttcatgcgcttctttacttaaagatccaaatgacatggcacctgtcttgaaccggcgcacgatggattcagcagattcaacgtcttccaaacgaactggtttttgttttggctggaaagcaaataaatttcggaggaagccgattctttcttcgtccgcagcttttgtatattgcttaaatagatcgtaatcttcattgcggcatgcccactgaagcgtatgaatcgtttttggattaaaggcatggtgctcaccattttttctccactggaaatcacttcctgattcgagggtttggtcagtcgctgcctgataccccgcttcatgacggagttttgcttcatgtgcaatggtctcaaggtcaatcccgccaagctgagaagctgttcctgtgaaatacgcctgaatgacgtcttcactgatgccgacggcttcaaagatttgcgctcctctgtagctttgcacagtagaaattcctactttagacatgactttgacgacaccttcggttacgcttttaccaaattttgtgactgcttcatcaaagctgaaagagatcgcttcttctgcaatcaactgtttgtacgtttcatacacaaggtaaggatgaatggcatctgctccgtagccaatcagtgcggcaaaatgatggacctctcttatttctccagattcaacgatcagactcacctttgtccgtaagccttgacgcacaagatgctgatgcagtgcacttaatgcaagaagaggtggaatcggcactttttcttccgtcatttcacgatcggaaaggattaataaagatacaccttcacgaatggctttttctgcctcttcaaacattgtatccagaccgcgtcttaggtcatctgtaaaaagtgtatgaatcgttttgcttttaaaggcattgtgaacaatcgttttcaagccgttaaactgcccgcttgttaaaacaggtgtataaagtttaattcttcggcatgaatattcatttggatgtaaaatatctccctcagcacctaaccaagtcatggttgatgtgacgagctgctcacgaatggcatcaatcggcggattcgtgacttgagcaaacagctgtttgaaataagagaacagagactgcgcacgatctgataacacagcaagcggagtgtcgcttcccattgaaccaattgggtccttaccttcttctagtaaaggaattaaatatttttgaatgtcctcgtacgtataatggaatgcacgctggcgcgtcaataaatcatccattatactagaattttctgaattttcttcagagcgattgacgtgaaccatttcttcatcgagccatttttgataaggaagttcattcgcaatcgaagatttcacttcttcgtcagaaataattcgtccttcttctaaatcaattagcagcattttacctggctcaagacgatctttatacttcacatcctcttcatttgtgtcgatcacaccgacctcagaagagaaaataatatgatcatcatttgtaacgtagtatctcgcaggtcttaatccgttacgatctaagatggcaccgatttgtttaccatcagtaaaggaaatggctgttggcccatcccacggctccataagagaactatggtattcataaaatgcccgtttctcttttgacatgtgcgtattctccgtccaaggctcaggaatcagcatcatcgctgtatgagcaggagttcgccctgcaagtacgaaaaattcaaaggcattgtctaaaatggatgaatcacttccgtctgcattcagcactggcaaaatcttgtctaaatcgtctccgaaggcttcagacacgaattgttgttctcttgctctcatccaattgatgtttcctcttaatgtgttaatttcaccgttgtgaatcaagtaacggtttggatgagccctttcccatgtaggaaatgtatttgtactaaatcgtgaatgaacaagtgaaaatgcagaaacaaatgtttcatcctgaagatcaagataaaaagcatcgacttgatctgatgttaaaagccccttgtatacaatggtttgactcgacaagctgacaaagtaaaattgcttttcctctgctgttccccagttctcagcctgcttacgaatgacatataattttctttcaaatgacagacgatctgtgatgttgtcgtttgcctcgataaagacttgcctcacaaccgggcagctcttcgctgcgacagtaccaattttcccggcatccacaggtactgttctccagccaattaatgtttgaccttcttgcttaatgaatccgttgattttttgctcgatggcttgacgcgttttctcgtcatcctcttttgaaaagaagaccatccctaccccataacggcccttttcaggaagtgcaaagtctttgcagctttttctaaagaaagtgtctggcagctgtaccattaagccggcaccatcacctgtatacggatcactgccttgcccgccgcggtgatcaagctggcacagcatttgtaatccctttttgacgatgctgtgtgtcgcttccccttttaaatgagcgtacagtccgatcccacatgcatcatgttcaaattcaggacggtagagaccttgtggttgtggtagttgattataagtcatcgtttctctcccccgtttaaaagatccgttttttcacagtaataaaatctcacaaactctgtaacttattttaagttttcaaattaatataaacaatatataatttagatgaaaacaatctctttttgagatagatgggtgtgaagtgtaaaaatggagcttcgtcagttgcgttattttgtagaagtcgcagaccgtgaacacgtgtcagaagcggctgaaaacttacatgttgcccaatctgctatcagccggcagattgcgaatttagaagaagaacttggagtggccttattcgaacgagaaggacgaaatatcaaattaacgaagatcggcagacaatttttagatcatgtcagaacggcactaaaagccattgattatgcgaaagagcaaattgatgaatatttagatccgcacaaaggaaccgtcaatatcggctttcctactagcctagcaagccaagtactgccttctgtcatttccgcctttaagcaggaatacccagaggtcgattttttacttcgtcaaggatcctataaatttctcattgaagctgtaaaaaatcgagatattgatcttgcctttttaggacctgttccgacaaacgatcctcaaattgaaggaaatattttgttttcagaaagcatttatgccttgcttcctgtcagccacccctttagcggacaaaggagtattcatttaagtgatttaagaaaagatcatttcgtgttatttccggaaggatatgtcctgagacaaattgcggttgatgcttgtaagcaggcaggctatgagccaaccatttcatctgaaggagaagatttagacgccattaaaggtctcgtatcagcaggtatgggcgttaccttattacccgaaagtgctttttatgaaaccacaccgcgatttacagcgaaaattccgatcgattttccgcaggtgagaagaactgttggaattattgcttctaaatcaagagaaatgtctccttctgctcatgatttttatgtgtttgtgaaggatttcttttctaaaattgaacaatataaataattcattaaaacaagacatttcatttgtggaaataatccctctttgtatatgatgagttacagaacaacacactatatggaagaaaggtatttgtatgaaatcaattttatcgtttttaaagccatatcggctatccgttgtgtccattgtgatcctcacctttttaagcagtatgctccagctgtatttaccgacgcttacggcagatatcgtcgatgttgggatcgtccaaggagatattgcttatatatggaaggttggcggctggatggtggcttgttctttacttgccatcttgctcacgatctggaagtcttacttgtcctcaaagactgcacttggcttcgggcgtgatatgagaagacagttatttgtgcatgttgaacaattttcactagaagaatttcaaaagatcggaacgtcttcctttattacaagatcgacaaatgatgtgaaacaagtccaagatgttacgatcatgattttacaaatgatgacgagagccccgctcatgcttgtgggcggaattattttggctgtatcccgcgatgctgtcctgtctctcatctttttagcagcgcttccccttcttggcggatttatctatttagtatcgagaaaagccattccgctctttggccagcttcagaaaaaaacagaccggctgaatttaattatgcgagaatctctttcaggcatccgggtcattcgcgcttttaaccgtgtagatgatgaaaaggaacgttttcaagaagccaacacatcctacaaggataccggtcttagagtcaaccgtttaatggcttacttgtttccatttatgctcatcatcatgaacttcacaaatatcggcattgtctggcttggtgcaaaccgaattgatgccggagagatggaagttgggaatcttattgcctttatccaatatgcgatgatgattttgatggcactgattatgctgtcaatgagttttattatggtcccaagagcacaagcatcagctaaacgcatgaacgaagtgttaaacatggaactgaaaattcaagacaatgaaggaacggttactgaccttcgcgagcccgcacaatccattcgctttgaggatgtgtcattttattactcaaatgcggaaaagccggcggttcaagacattacgtttgaagccaaaaccggtgaaacgacagctattatcggaagtacaggatcagggaaaaccacccttctccagctaatgacgcgcttttacgaagcaacagaaggccggattacactagatggtgtagacattagagagctgcctcagaagaaactaagaagccagatgggctatgtttctcaaaaagcggttttatttagtggaaccattgccgataatgtgcgctttggcaggcaggatgcaagcgatgaagacgtctggcaggcgctgcgcacggcgcaggcagaagaatttgttttacaaaaagatggcggcatcgatgcggaaattgaccagggtggatcgaatctatctggtggtcaaaagcagcgtctctctattgcaagagcgctagtgagaaagccgtcattctatctgtttgacgatagtttctcagcactcgattataaaacagatgcaaagcttcgggcatctttagaagccgaaaaagcacatgccgctctaatcattgtggcgcaaagaatcagcacagtgaagcatagtgataaaatcatcgtactagatgaaggaaaaattgcaggtatcggaacacatgaacaattactgaaggacaatcttgtctatcaagaaattgttgcatcacaggaaggtcaggaggtggagccaggatgagtaagaaaatgtcttccggcatgggccataaaggcggccaccctagagggcctgtcgcaaaaccaaaggaatttaagaaaacactgcttcgtttgattggttatttgaaaccgagaaaatttcagctgatccttgttttcattgcagcggtcggttcaaccgtttttaatgtcattagtccaaagctgctaggggatgccacctcttccctatttgacagctttactcaaggaacagccgttcaatttgatgtcatttcacgtattttattattgcttgtccttttatatgtcgttgcctctctcttttcatttgttcagcaatatgtgatggcgggtatctcccaacagaccattgctgaattacggcaagaagcaaatgacaagctcacacgtctcccccttcggtattttgataaaacaacccatggggacacgctgagccgtgtgatgaatgatattgataatattaatacttcgcttcagcaggcactcacccaagtaattacatctgttatcacggtcattgggattgttgtcatgatgctcttgattagtccgctgctgacattgcttgtttgtttaacactgccgctcagcctgtttgccattcgcggcattacgtcattttctcaaaaacattttaaagcgcagcaaaaagagttaggaatgatcaatggacatattaatgaaatgttcacagggcatcaaacggttcgtgcgtatggctacgaaaagaaagcgatcgatacatttgatcaattaaacgaacagctgtatgaatcatcaagaaaagcgcagttcatatccggattaatgatgccattgatgacctttatcgggaacctaggctatgtggcagtcagtgtagccggcggtattcttgtgattaacgggaatattcgtgtcggggatgtgcaggcatttattcaatacacgcagcaaatgtctcagccgctcgtgcaagcttcaagcgtcgccaacttggttcaatcagcgattgcttctgctgaaagggtgtttgacatcctggatgaggaagaagaaagtgccgaggaagatgcagcaattaaccttgaatcactttcaggcaatgtgagctttgaacaagttcaatttggatatgaaaaagaccatccgattattaaagatttgagtttagatgtcaaagaaggacaaacggttgcgattgttgggccaacaggcgctggaaaaacaaccatcatcaatcttttaatgcgtttctatgaattagatcaaggctctatccgcatcggcggcgtcaaaacaactgatctcagccgtcagcaagtacgcgacttatttgcgatggttcttcaggatacgtggctttttgaagggacgattcacgacaatattgcctatggcaggcagaacgtctcaaaagaggatgtcatcaaagccgccaaacatgcttatgctgacgatttcatccgcacgcttccacacggatatgacacactcttaacagaagatgccggcaacctgtcccaaggtcagcgccagctgttaaccatcgcccgtgcgattttatctgatccaaagatcttaatactagatgaagcaacgagcagtgtggatacacggacagagatgcacattcaaaaggcgatgaatgagttgatgaaaggtagaacgagcttcgttattgcacacagactgtcgacgatcaaagatgccgaccttattctagtcatgaaagatggcaccatcattgaaaaaggaacgcacagcgaactcttaaaacaaaatggtttctatgcagacttatatatgagccaatttacggagaatcaagtcggttaaagataaaaaaggatagacacgcatccatgcggtctatccttttttggttactctaaacgctttttcacttttacactgagtttcgttatatactctgcttcatctttagacatgagtgaatgaagcaaatactcctcaaatacatctccatccagcatcatgtcctctttttcaatttcatctaacaagcgcgaataagcagattcaatcccttcatatgatccttgatcatacatcaccgcataaaggcccgcaggttttttaactgcttccggcgcttccatccggcaaaacaactgatctgactgatgatattgacgctgaaggaactgctccttttttaagacagctccatttgccgcagccccttttatgccaatttcctttagaaaatgtccaacaatacgagatatttcttctacggatgtattcatgtcaatcgggtttgacacgcttaatacaactggttcttctgggagctcttgaaacagcacctctcctatttttacagatgatagttcctgcgtcgtctccatgacccgcataagaaaagactggatatcttgaagtttttcaatctcttgtttgaccttgtctatttgttcagctgctaggcgttggagcctttcgcgagaaggctcagtgaaatattgttttaactcttttatcggaaattgcacagctcgaagggattgaatcgctataaaatgatcaaattgctcaagggtatagtaacggtacccattttcatgaacaccagctggcttaaataaaccaattttatcgtaataaaacaaagtatctttctttacatcaaataacttggcaaattctccagtgaaaaaagttttttgcacatcattcatcatcattaaggctcccctcttgactatggagttactccaccctttatgataacatgcagaacaccactacgcttggaaaggatataaacatgaacaacatcattcaacatgaagtgacattagaacttgccaaaaaagaggacttcccttttatgaaaaatgagctacagaaagcttttacagctggcgtgatcgacgcatttggcgatgcgcatgatggaccgattcctccagatgatgtgattgatgcatcttttcattcgaatgaacacattgtttatcatatgatgctaaatggcgaaaaggcaggcggcgttgtcattaaaatcaaccaagagacccaccacaactcagttgacttattatacacctcttcatcctcacacggaaaaggcattggtcaggctgcatggaaagccatcgaggcgaaatatccagaaacgattgtttgggaggttgtgaccccgtattttgaaaaacgcaacattcatttctatgtcaataaatgcggctttcaaattgtggagttttatcatatgaaacatccagatccaaacgcacctcatgaaactgaccaaaaaaatgagcctacagcacctgaagaatttgaattttttaagtttgagaaagtgatgaagaaaacctgttccagccaataaatatctgcatcaaaaaaacactacccccatgaaaaaggtagtgttttttgaatctcatctagcttctaatctgaccgtcaccagaaagaagcagcttcgttgttgtgagtgctggaagtcccattggtcctctggcgtgcagtttttgtgtagagatgccaatttcagccccatatccaagtgcacctccgtctgtaaagcgagtagatgcgttatgataaaccgccgccgcatcgacttcgtttaaaaacgtgagtgcctgcttttcatcctctgtcacgatggcttctgaatgttttgtaccgtacttttcaatatggtggatcgcttcgtcgattgaatcaactacctttacggcaaggtcaagacttaaatactcatctgtccagtccacttcctcagcaggaatggcgtttgaaaaatgagacagtgcagcctcatcgccatgaacggtgacatggtgctcctgcagggcttcattcaatgatgccgcattctctttcagccaatcgcgatggatgatcagcgtttcaagcgcattacatacagctggacgattcgtttttgcattgatgacgatctcaatggcttttttcacattggctgtttgatcaataaagacatgacagtttcctgttcctgtttcaaggacgggaatcgtagattgttcaaccactgttttgattaaagaagctccacctcgcggaattaagacatcaatccattcttttagatgaagcatcgcttgaaccgatgaacgatctgtttgttcaatcaattgcactgcatcacgcggaatctttgtttgatccaatgcttcatgaatcacactcacaatggctttgttggaagaaatagcggaggaaccgccttttaaaatcactgcgttacctgccttaagggcaagccctgctgcatcgacagtgacgttcggtctcgcttcatagatcatcccgatcacgccgagcggtactcttcggcttttcacatgcaagccgttttcaagagtccattcatccaatatttctccaacaggatctgttaatctcgtcacaagccgtaagctttcggcaaactcatgaattctttcttcatttaacattaaacgatccaagagtgcctctgagaagcccttttccttcccggcatctatatctttttgattctcttgtaagatgaaggtgctattttgttctaacgcttctgccagtttaagcagagccttgtttttatcctctgtatgaagtaaacctagtttttttgaaacgtgctttgcttttttcgctttttctttgactgttgtgacaacttcagctgtcagtgtcatgaaattcctccctttttgttaacaaacgggtatcgataaatctaaatgacaaacaaaagcttcaagatcgacgacatgaaccacttcatcctgtaacgagtcactgccttgtgcaagttcatcagatggataattcacaataccaagcccgatttctctaccatcttgatctaaaatacggacgacatcgccttttttaaacgaaccctttacattgacaatgccatcggaatcaaggcatttctcccggtgcatgaggtgttcctgtgatttcttttgaataacgatctcgccttttggtccagaatgaaaggcaatccactgcttcttgtaattcagcggtgctaaattctcatcagcggtaaaataagtgccgtcctctgttccattgattgctttgtctaaaatgtgaggcgtatctgcttttcctaaaaagccattaatgccagcggccattgaaattttaaacgcatcgagctttgatttcattccacctgtgcccacactgctgcctgcatctccagctgctgcttcgatgtcttctgtgatgtctgtgacttcaagaattctcttcgcgttcggatttgtatgcgggttctcttcatacaagccatcaatatcagataaaatggcaaggaaatccgcatcaatgagtccagctacttttgcagacaatgtatcgttatctccgaacttcaagcgattaatcgtcactgtatcattttcattaataatcggaatgatgcctcgatctaataacacattcatcgtgttgcgcacattttgatagcgcgtttcatctgaaaaatcacttcttgtgattaaaagctgtgaggcaatataaccgtgtgataaaaataaagtagaatatgattccattaaaagcccttgcccgattgaggcagatgcctgtttttccggcagtgttttaggtctatcgataaatcctagttttcggtaaccagctgcaaccgcaccagatgaaaccaaaatgacttcgtgtccttcatctttgagtttcacaatttgattgacgaggttttctagtttttttaaactaatctccccttgaaagctagtaagagagctgcttccaattttcacaacaattcgttttctctctttatctgcgtacaccttatcactcctgtacctgagctctatttatatagatactttttgtttttgctgtttgctgatctcttttgatcgattggcagcatgtttgacggcttgcttgattgcttctcctccgccaaaatcatctaatgcattcagacctgccgctgttgttccatttggtgacgtaattttctctcttagagtagaaggatcttcctctgtttcttgcagcattttcgcagcaccgagaagtgtctgcgcgccaatttggcgagacaattccttagataaacctgcttcttctcctgcttcttcgattctttccattaagaaataaaaataggctggtccgcttccggcaatgccagtgaaaatatccatctgttcttcctgaatggtatacacttcgcccatttcagataaaagcgcctgactcatgctgatatgggcgtctttcacataacgtccagcacataaagcggtcgctgaagccccgattgtacttgatgtattcggcatgatcctcatcacgggctgcccttcatgcagcatatcttcaatataagattgcttcacacctgcaaggacagacaagatcagctggtcactctgaatatgaggttttaacgattcaagtgctgtttcagcatcctttggcttcatggccagaatcaacatatccatttcttcaaaaggaaaagaatccattgtggctgtttgtattccgtaacgtgtcgttagttcattcaatcgaagttgattttgtctgtttgttgcgtaaatttggcctagcggcatttgtcctgatcgcacaatccctgcaatcattccttccgccatagaacctgctccaatgaaagcaactttcttttgatcaatgatattgaccctctccctcgttcgctttttgttcgtgtttttcgcacgttagttatcgtaacatgatgagaaatcgtgtcaagaaagagccagcgcttttcaaaagtcccgaatacgcgttcaatcgcttgctgtatgtatactgactgcgcttttacaaaacaacaatttagatctaatgaactatatgcatttgcatcatagtaccctttcgttcgactgaattccccattttatttttggtttcggtgacttcaattctattttatagaaaacgctatcatttctaatggattcctattttcctatacgacgaatgtgcttgaatctttcgattagactattgacatattttagaaaacatgtccgttgaaatgatattttacgggtgttaccgtgaaagggaaaccaagtgaaaaaggagcgttcataatgaaagtgaaagaaaactatatcaatgtcattccaatgaaagaaatccgttcgaccgatgaccttcttttcccgttccctatttacaatgagctacgtaccaagagtgatattagatatgatgaaacaagaaagtgctgggatctctttcgatatgcggatatccagtctgttctgaagcagccaaaagtgttctcatcacagcgaggaagaagcacgacaaaaacgagtattttaacgatggacccgccaaaacatacaaaaatgagagcactcgtgaataaagcattcacgccaaaagcgatcaaacaattagaagataacattaaagacttgacacatgacctgctgcaacaagtcaaagatcagcgtacgtttgatatcgtggaagatctagcagctcccctgcctgtcatgatcattgctgagcttcttggcgcagagataaaggatagagcgttcattaagaaacattctgatgccctagtagcaggtgcaaaggatgaatcaaaagaagccattcaagcagtcgtcgatatgcagaaacgcgcagaggaagagctgtccgcttattttgcacacttaatccaaaaacgaaaagaagcccctgctgatgacctgatctcacttcttattcaagcagacatcgatggtgagcgtttaaccgagaatgaactacttggtttttgtattctattactagttgctggtaatgagacaacgaccaatttgattacaaatgcagtaagactgctaacagagcagccgcatatcgccgaagcagtacggcaagacccctctcttattcctcaattgaccgaagaaacgttacgctattacccgcctgttcaagccattgggcgaatcgcggccgaggatgttgagattgcaggctcaaaaattaaaaaaggagactatctcattaactgggtcgcttcagcaaatcgcgatgaacagaaatttgacgatccagatacattccgtcttgaccgaaaatcaaacccgcatatgagctttggctttggcattcatttttgtctcggtgcaccgcttgcccgccttgaaagcaacattgcacttgaggttttactccagacgtatcaggatatcacctgcgcggcagatcagctaaaacctattcaaagcacttttctttttggggtaaaagaatttcctgtacagatcacccgtttttaaaagtccctcttgaggggctttttttcattttcttcaattcatcatctctttcttatcttccatctccgaacatgctaaaataaagtccatataaagagataacggatttcagaaaaggagccaaaaattcatgaccgattttacagcaatgaaagacggaatattcaaatcagtttgttcgttagattgcccagatcagtgcggtcttttgatacataaagaaaatggaaagatcgtaaaagtgcagggagatccagaccaccccatcacccaaggcaatatatgtaacaaagtgcggaatgtcacagcccgtttatatgatgaaaagcggctgaccactcctttgaagcgtgttggtcgaaaaggcgatggacaatttgctccgattacgtgggaagaagccattgaaaccattcggcaaaaatggacaaagctcattgaagaaaaaggtccagaaagtattctgccatacagcttctatggaaatatgggtaatctgaatgcagaaggcatggaccgccgctttttctatcgtcttggttcaagtcaattagaccggaccatctgtcagtcagcaggaacgactggctataaatatacaatgggtgcaagcatcgggactgacccagaagacaccattcatacgaaactatttatcttttgggggatcaatgctgtgtcgaccaatatgcatcaaatcaccctcgcgcaaaaagcccgaaagcaaggagcaaagattgtcgtgattgatgttcacaaaaaccaaaccggacggatggcagattggttcattccgcttcgacctggtactgacagtgcccttgcccttggcatcatgcatgttctttttaaagaagaattgacagatgaagcctttttagaaacttatacaaccggtcataaggagctgcgtgagcatgtgaagcagtatgatccagacactgttgaggagatcacaggggtttcaaaaaaggacatcgtgacactcgcaagaatgtacgcagagacatcgccatctcttattcgtattggcaatggtttgcagcaccatgataatggcgggatgagtattcgtaccatttcctgcctccctgccctgactggccagtggctctacaagggaggcggtgcgatgaaatcaaactcttcttttctgagctataatgaaacagctcttcagcggccggatttattaaaggaccacacgcctaggtcatttaatatgaatcaactgggcagtgtgctgacgaatgcagcgccttccattgattcactctttgtctactcgtgcaacccagctgttgtcacgcctgaagcaaataaagtaagagaaggtttgctgagagaggatttatttacagtggttcacgacctatttttaacagagacagctaagtatgcagacattgtcctgccggccacatccgcctttgaaaatgaggatttctatacatcatactggcaccattatattcaaattcaagagccagtgattgaacgctatggagaaagcaaatccaatacagaagtgttccgcttgttagcccatgcgatgggctttgaagatgcagccttccgcgagacagatgcggaactcatggaacaagcccttcatcatccagaaaatccgcattatgaggacatttcatacgaagcattaaaagaaaagaaatggattaaagcaaaaagaggacctttccaagacttaaagctctctaccccaagcgggaaaattgagctttattcggaacaaatgaaaaaagacgggtatccagcgcttccaacctatgtgccgctctatcaagaaagcgaatatccacttaccttcatacctgggccgaatcataattttcttaactcgaccttctcacttcatgaaaagcaccaaaagctcgagaagtttcctaagcttcacatgaatgaagaggatgcaaaggcaagagagattgaagatggtgacatggtgcgtgtgctgaatgaccggggtgaatgcgagcttgtcgtgtcagttggtcaaaatgtcttatccggtgttgtggtgagccaaggattatgggcagatcaaaaaggcaaaaaacagctagtcaatggactaacacctgatcggctggcagatatgggcggcggtgcgacgttcttttctggcagagttgaagttgaaaaacgatcatagacagaagaaaagccagcaaaatctgctggcttttttgtattcttttattgtccaatcatcagctggttggtaaacacattcgcacttccgttgcttcggtagccttctacagttaatgctgtttcatacattttccccattggcatacctaggctttcccattttctgaaatgctgactgacggatacagttccgctcgtacgttttgtttgacgtacactccaatattgcttaaaggtagcgtctccaataatagaaggctgattgacacgtagcgtttcataaatgtcatatgtgccgccatcggcataaaatgatcctttatacgttcctgttgggcgataagtgccccatgactcaacaatgtagtattcagctaatggagattgtgtccagccgtagacacataagtaggaattcccgcctgggttaaaggctgcgttgtaattgatggagatgttgccaagttgatgatgagttttagtggaatcaaacttcttcccttttcgaaacagagcatttccgatattgttccattgtgcgctaaatgcgccgccattattgagtgtcattgacgtatttccgtaatctttccataattcaaaatcgtatccgccgtgtgtgccgattctattatcataaatcgtttccgcatgagctggcacagccgtcagtgtcagcacaaatccaatacacatcacaaacaatagcctcaatcttttcaaattcatttttcatccctctccttttttcaataaaattgttctgccttctctaagatgaagcgagcccaccacctcctttcatatcacccttttctgctagatggaacgatatttcgctaacccggcatggatgtctcttgtttgtgtatagatcttttgatacagatgaaatagatcagcatatatacttgcatgctgctgctctggctcatagacagctgcttggtggataaactgttccgcacatgcttcaagcgacggataccagccgcagccaacggcggccagtatagctgctcctaaagcaggcccttgttcattgtctaactggatgacctcagcctgaaaaatgtctgcttgcatttgaagccatgtccggcttcttgcaccgcctccaatggagacaattgaatctatgtgtttcccagcttgcctgaataaagcgatcgattcatttaacgagaaagtaatcccttctagcacagccctgacgacatgtgccctttcatgccggctgtctaatccgatcaagcttccacgaatgatagaatccgcatgaggtgttctttctcctactaaatagggtgtgaagagcaatccattcgctccaggcgcgacatcaaccgcaccctctaaaagcgattgaaacgattcttctggagccagcaaatgttttacccagttcaagctatatcctgctgaaagcgtcacacccattgtgtaaaaagcatctttttttgcgtgatgaaacaaatgcaagtttccttgaagcgctctttcatgatcctcttcgtaagaaagtatgacgccagatgtgccaatgctgcataacgtgcggccagaagataaaatgccagctccaattgctccgcaagcattgtctgccccgccagcaaacacttttgcgccctcttcaatccccgcctcacgtgcaatgtgcggcaagagtgtaccgacctcttcctctgatgagataagcggcggacaaatatgaggaggaatatcaaatgcctgacaaatctcttcactccacgcttgctctccaatatttaataacaaggtgccagctgcatctgaataatcgatatgaacagaacctgttaaacgaaatctgacgtaatcttttgggagtaaaaacatgtcgatttgttgatcaatttctggttcatgttcctttacccataataattttggcagtgtaaatccttctaacgcttgatttttcgtaatcttttgcagtcgttcccccagcttttttgtgatgtgtgtacattgcgctgttgttcgtgtatcattccataaaatcgcagggcggagcacctcacgggattcatttaaaagaaccagaccatgcatctgtccagagaagctgatgccctctactttctttgaaaaggcaggctgccttgccatcagttctttcatcgcagccactgtttgctcaacccattcctctgggttctgctcacaatatccaggtttatcttgaatgaggcggtaaggcttagtggcctcgccgcacacctttccatcctcatcgactaatatggctttgactccgctcgttccaagatcaattcccattacatacttcatgtcttcactccttcaaaacaggtccgcttcttcaatcaatcttctaataaatattgatttaaccgggcttttaattgttcctctcttcccgattcgtttctgattaaaggatgtttgagcgcatactcttctaatgtatgaaaatttgcctttccttctgaaatgtcacgtccaatcccttcagaaaaactgcgataccggtgcttgatcacatcttcaaacacacgatcttctatgagtctatgagcgacccgcagcccttttgcgaatgcatccatccccgcaatatgggcatacaaaatatcttcaagctcaaaagaagctcttctaacttttgcatcaaagttgagaccgccagtacctagtccgccattttgcagaatttcatacatagcaagcgttgtggcatataaatcggttggaaattcatcagtgtcccagccaagcagcgtatttccttggttcgcatccactgaaccgagcaatccatgtattctcgccatgcgtaattcatgctcaaacgtatgaccagcaagcgtcgcatgattcgcctcgatgttcaatttaaaatgggaatctaatccgtattgctttaaaaaggcgatagatgttgctgcatctgcatcgtattgatgagtggttggctcttttggcttaggctcaattaaaaattggccagtgtatccaatttcctttgcataatcaacagccatatgcaaaaatgacgccatgtggtcaagctctcttttcatatcagtattcagcagagtatcgtatccttctcgtcctccccaaaaaacgtaattttctgcgccaagttctttagctgtttcaatcccttttttcacctgtgcggccgcataggcaaagacatctgcatgacaagatgtcgctgcgccgtgtacaaatctaggatgcttgaacatgttggccgtgttccacagcagcttgactccgctatcttgcatgtattctttcattctttctaaaatgatgtctaattgctgattcgtctcttgaagcgtatctccctccggtgcaatgtcacggtcatggaacgaaaaatacggtacatccaatagatcaaacagttgaaaggctacttccaatctagcttttgctaaatccattccgctataggaatcccaggctctctgcatcgtgccagttccaaacatgtctgttccatcagcagtcaatgtatgccaataagcgactgagaagcgcaggtgatctttcattgtttttccgccaatcatttcgtttggatcatagtatttaaaagcgagtggattttttgattgttttccttcaaattgtatttttccgattccttctaagctgtgtaacgttttcatatttgagttggccatcttttattcctcctatgatttcactttgtaagttgattcaacaaactaatgttcaattgatgatccattcactttgaattttccatattttttagttttttagaaatattttcgttataataaagttaaaatcatccttcttacagattacagacgaagaaaaacagcttttttcttcacttaatctaaagacgaaacaaatggagtggataacatggatatcgctgatcagaactttgtaaaaaaaataaatcaaaagctattattaaaagaaattctccagcatgcgccaatttctagagccaaattatctgaacgcactgggttaaataaatcgacggtttcctctcaagtaaatacattaatgaaagagcagctcgtctatgagatcggccaaggtgagtccagcggcgggagaaggccggttttactcatgtttaataaacgtgctggctgctccatcgggattgatgtcggcgttgattatgtcaacggcattttaaccgaccttgaagggtccatccttcatgaggagcagatgaggctcccatcaagcgctcctgatgtgaccatacgaatattaactgaattaatacagcagttgatgacccaaatcccctcttccccatacgggctcataggtattggcctatgtattcccgggctagtggatgctgatgaacagatcgtgtttacgcctcattctaaatggaaaaatgttgacctgaaaacaacgctacaagatgcattccaagtaccggtctttattgaaaatgaagcaaatgccggtgcatatggtgaaaaaatctttggtgccgctaaacattatgatcatttgatctatgccagcatcggcactggcattggaatcggaatcattatcaatcatcatttatacagaggcgcatacggcttttctggtgaaatgggacatatgaccatcgactttaatggaccaacatgcagctgcggaaaccgtggttgctgggagctgtatgcatctgagaaagccttgtttcagtcccttcaaacaaatgatcagcccatctctcaccaagatgtggaacaactggcgacgttcaatgatatgaaaacgctcaatgccctgcgcaactttggtttttaccttggggtcggtctcacaaacgtcctgcatacctttaacccgcaagcgattattttacgaaacaaggtgattgaatcgcagccagcggttttacgtgtgattcaagaggaggtatcctcaaggatagatactcaattcagttcacatgtcgagctgcttccttcgtcattaggacataacgcaccggtattagggatgacttcactcgtcattgaagcctttctgcaagatgccaccctctcaccatgacagattcttcaataaaaaagacagctcttaccgtgttgtctttttttatttattctgtttcctcataacggaaatagttgaaatcagcaggcagacgctcgccgcttgtatcctggcactgcatgccgacaaatgcccctgtaaaaaatccccctcctcggatgaagtcatcagatagatggctagattcaaatatcacatcaatttccttccagtctttttgatcaaaagaataagaataggtataagtttctctctgaacggtcacttttaaatacacataggtgacctcctctggaatgacgattttttgtgtcaatggctgagaaaaggaaaggttctgacaggcagataattcaagaatacgaccaagttcctcgtcatatgtcacctgaagcgcagtccaattttccgtattataataattcacaagaccagcggcttgctgaaaattctctggaaagaacgacacagctgtctctgcttcaaaataaaagctttgccagcgccttgcaacgaaggattgggtaaacttagatgtgagagattcctgaccatataaccttaaatgagtaggtttttccgttaatgaaccgatctgttcagtaaaaggaattcttaatgtttggaagtgtctatttaacgttgattctttaaactcatcgactgtatggtgtgttggagcaaaaatcttttcgttgatcgctggcgcttcaacctccagcgatccttcttttccgcccacaacatacggccagccatccttccattcaagcttttgaatcgctgtttctcttcctaaaggacaccaccctctctgttgaaaaatagattccttgcttgattgaatagggcggccagtcagatgagcgaggtaccattcatttgtgtgcgtttgaacaatggaagcatgcccgcatttttgaagcggatgttcaggcgtgtgaaaagcacttaaaattgggttatcaggatgaacctcataaggcccttcaatctgcggggaacgagcaattgttgccgcatgctcgtacctggtgcctccttctgctgttaataaataatagtaatcaccgatgtgataaagatgcggtgcttctgtcaatttaatcggtgtgcctttaaaaatgaccttccgctggccaatgagtttcttttccgtcacgctatattcctgcagggcaatacctgcaaaggaatggtgcttttccctatggtcccacagcatatttaaaacgtatttcttgccgctttggtcatgaaataaagagggatcaaagccagagctattaagcttaaccggctcactccaatcaccatcaacgtcacttgccgtaaccaaataattatgaccatctttaaatggaccatccactactttaatatctgaataaataagccaaaactgaccatctgcatagcttagacacggtgcccatactccgccagaatcaggattccctttcatgtccagctgcgacgttttttgcaaaggacgcgcagcaagccgccaatggacgagatccttcgaatgataaatttgcacccctggaaaccattcaaatgtagagaccgccatgtaataatcttctcctacacggcaaatacttgggtccgggttaaatcctttgagcactggattggtaattttcattcaacttcctcctctttcacgacctacattttaaaatcatccatatgatcgatatatacttgatccctattctcaagctccctcacgactttttggtgctcttcttcatctaaattataaaaattaatatcaatcatcgctaaaatcagtaagcatacgggaatcactgttaccgtaattaaaatgccaagcaatgcttctggcgtctgtatttggtttgcaacatagccaaatcgatcgagtacaagccccggaacgatcccgcctaatgccatcccaaatttaaagaaaaatccaatgactgcgtagataagtccgcccatcctttttccagttttatattcgccatattcaacagtctcaggaatgagtgcccacatgtatgcaccggctgtaatactacccgcagcagcaacgagtctgaaaatcaggattaacgtgatttgactcggcggtatcacaagtaaggcaagaagacctacgatattcagcgataaagaataattcagcagctttttcttacctaacaacttgtgcagcttcggaataaacggcagcaccattaaagctggcagactgccaatgagtccgtaccattttactaaatcttctctgccaaggttatacgtcacataatagatcccaacagagttgctgatcgagttcacaccaaaaataataataaagaaaatacttaatacaacaagcgggcgattcactcgtaactggacaaaaatatcactgaatttaatcttttcctctggcttttgaagcgtgacacgttcattcgtacttttaaaacagaaaatcaataatgcgccgccaagaacgccgagaaaagccatcgtcatctgccagccaagtgctgtatttcctgtcgtatcacttaaaaaggtggcaagaaaaggaacaaaaaaagccacaaccagaccgcctagattggcaaataccatacgaacggacgtaatactaacaacttcttggttatttcttgtcattgcggaagttaaagcaccataaggaacgttgatgaatgtgtatgtaagcgataaaccaacatacgtgatgtaggcataaatgagtttacccatttcggaaaaatcaggtgttgtaaagcagaggatggcaagtacgacaaaaggaaacgcaccgaataacaagtaaggtctaaacctgccaaaacggctgttcgtccggtccaccaatgcaccaataaatggatctgcaagcgcatcaatggcacgaacaaccaaaaacatcgtccctgctgctgccgctgataaaccgtacacatctgtatagaaaaataatagatatgtagagacagttgcgtaaatcaaattacatgcgaaatcccctgaagcatatcccactttttcagacatacgaatcttctttaaattctcactaaccatgagctttctcccttcttcacttagcctcttctaacgaacagatgatggagggcagcagcaatcaatacgcggaatataaagcgctttcaatttgttataaaaatgtagctgaacatctcatcctttcagcttagcccaaatacgcagcaaaacagtcgaatgacagaatcatctccttcaatatagggttcgatacttgaaattcatcttagtttattgactaaacaaactaagatgaattcattttataaaatctgatctgacttttcaatattttttgaaaaaataatccaaataatcgatatcttgtcatttatcttttgaaatgacatgaaaatctaaaagaattcatttattggttgcattcaagctcatcccatgctatattaatcaagcgatgagcttaattgtgtaagtcgggtaacatgtctctttgagacacacacgaatgtggcgtgtggttattccgcctcaatacgcaaaagacatcttcctaagaagatgtcttttttcttaccctatttttgttccattctcaaccggttcatccgtcgctagcaaaaccacgtcttcttttgacggcatgcctcctaagacaagcacttctgatttgaacccagcaattcttcttggcgggaaattaacgaccgctacaatttgtttgccagtaagattctccgctgtataacgctttgtcagctgagcactagattgcttcacaccgatttcttcgccaaaatcaatcttaagtttcaacgcaggcactcttgcctctgcaaaaaattctgcctctatgatcgttccaacacgaatatctaacgccaaaaactgttcaatatctgccatctgattctctccccttcgtaaaagataacgtattctattgattatccattgtagcacattcattttgtcaaaaaggaggttcaaaaatcctatacagcgctaacatcatctttatagtttacataataaatttatagtcgcgtattaaatgtttgcatcctaaaaatgaattcggtagaatggcaaataatcctactgcttcctctcgaataatttggggagggttcacacttgtttacactatcagatatgtggacgttttgctggtcgttttttgtcattcttcctattgttgccatcctgcatcaacttggccatattgtggtcgcgtggatgtttggagcaaaggtttcctttgcgcttggcagaggcaaaaaagtgttgaaagtaggcgtcgttgaaattagacggatctattttctagatgcattttgccactatgaagaaatgaggaaaaataaccgattgtcgcacattcttgtctacttaggcggttcattatgcaacttgctcagtgttctcatactgaacacaatgatcgccaatgatttcctgccagagcaccaatttttctatcaatttgcttacttctcagtctactatgtattttttgcacttctgccagtccaatatgcagatcatcatccgagtgatgggcaagcaattgtaaacatcattcggcacggtgaaccatgtgacatcattgactaacacgctgactttcactgtcaatatgataatgaatcgttaaaaaaggaataccgaacagcttcatttgatgtaccgctgtgagactttcatccgtctgcggcttcatatgaaagctttcttccattggcagtttcatggtgataaaaggcgtatgcaaatacaatccttcgtcaccggtactgccttttggacatgtgctttttaataaaaaatcttctttctcattaaaaggctttaaaatagctgtcagctgagaataaggaagtggcagcgcaatattcaaataacccccatctgcatcgtaatgaagagcataaagtgcaaaaaagacttgctctccttttgcgttgtgacgtatccaagcccgaacatttttcctttcttccttcggatgttgaaatctagtcagacgtcccttcatttcatatggatgacgagataaccccaaataaagctgacctattttcttaaacattggctgaattaaaaaaacaaacggccttacccaccaatgaaagctgacggctgcttttaatgtgaatgccatagggtcttcataaaatctgcgaatcacgggtgacaccctatcagctgaaaacgtctttccatttaattcatcaagagaatcgactaaacccagcttctcagagtcatgcgcgctgtcctcttgaatcgagatcatctgaaaccggccatgcactttcgaaatcggaaagttcttctgctttaattgatccttcggtccttcaatcagccagccaatcaaacctggcataatcacaaaaaaagcattgatactgccatgaaaccaaatcatctgatcaatgctaatgtaggtcacacgcatcagcatacctgcggaataaagaagtgatagcacgatcgtccccattaaaacaaagctagaaaacacaacgagacctttcgccaaagttgaccgaaatcttgttttcacacaaaggaagccatatatgtagagggccatcacataaagaatgacgctgaacgtatcaaatagacgggaaaagctaatcccaacagcaatcatcagaggcgacagcaaaatcacccatcccgccgctttgtataaagctgtttcttttgctggctgcctccctaataatccataaaaaagcggaataaaaaaagcggagtaatgaaaatgaatagcggtcaaaagaacaatgatcggcgaaaatgtcatcacctgtatatctgctgtgtatagccaaaaccacagaccccctaaagcgagatacatccatgcaccatcaatcatcagctcatgaagcggaaagattcctcttttcaataaacgagaaaagccaaataccgccaataagattgtatataaaagccatcccgatgcaaaccaagcggaatgatagataaaagcagcggttgcacaaagagccgctagtggaaaggctttcattaaaaagccgatcagcatccctggcttgtgtttcttcccttctttctcaaaaaagtgtaaggcagcgggaagaaaaaatagaatcgccatgagaacaaaaaattctgctacccggcctgtcatgaaacgggtggcaataaaacaagacatgaagatcagactggatgtcaaatgccacttattcatcatgagccatcctttctgtaaaacggcctttatatgtaaaaagagtaccaaacaggcggtttttcacgtggacatcaatggtatattcacctgcatgctcatcgtagccttccgttacatctgacacaccataaagccatgaaggcagcggccattcttttctgaacatcaaaaacttctgccggccggattggatgtgcaagaaaccatgctttgttactgtaaaatgaagctctgacacaagaagtctaggctttccaaagtaatctagtactgtatgactctcctgatcaatgatcatatctgcatcaaagtgccgctccttctttgggaaataaaacgttcgataccagtgcatcccttcctcccccttatttgtcacaaagggctcgttcacaatttggaaaggaatgtttttacctcgctcagggaaaaagcaacgaaacagtggacccattctgaagatcaaccgaatgagtcttgacccgccgcctatttcctccatagtaccttcagcagaaaacgcgcggttgtatctctcttttagctttggatgcagtttatcgtaatcctttacttgatgacgatgaacgaccatgtctacctcccctttttcgcttgattgaaaatacatctacacaatcttttagattgatcatacctgcaatcgacaaaatgaaaaatgcactcatcacaagcggctcataaagcgtcgtttgcggggataggatccctatacaaagcataatgagaagaaacatactttgtaaaatgaagagatatttctttgatagtttgggaattagccatgatacgcctaaaagcgcataaaacaatcggaaactcgtgctatgatcaaaagctgaatgtgaaaaaggaatggctgcttggcttagccagacgatggcaaacagcaaacaaatcccgtaatgagcaagggttctctctagtaataaccgagggtgcgttcccttttcaagccacgtctttaatgcaccaaaactaaaggctgtcataaacccgatcattgggcgaaaaagaatccggtctgcccatgtccatccttttccttctttcgttttgtaatcaaattgagtttgaaacacaatgtgatcgcttgttttcatatacttccagtagccgctgccttctttgataaaagacaatgggtgtgacgatttgaaatgaagtgaggatgcccgctcattccgttcatccatcattcttgttcgataagctcctgtccctgtgacacttaaaccaaacccaagatgcttttcatacaaaaaggattggggctgttcattttgaggttcatttaatgaaatggttgaaaagcgcaaatcccattgttcatgaagctttggattttgcgtatactcccatactttctctatcggtgcatgaatggttgtttccacataaacgggctttcttttcatctgcctctactcctctatgtgaattatttcacataataagcataccatgtttcacaaaactgtcaaatctttattctttttttttgtcaaaaaattggttcaagatgaccgcctctaaaacatatcgatccactaccaaaaaaagacctgtcaatgagacagatcttctttttgcaacacacctgagatataaagcttgaccgcatagctcacactgtcttcaagctgttcttttcgttgaaatccatttttatttgaaatatcaccgaagccgtgcaataaacttcttagtcctctgaccacatgtgtcatctcttcttctttgacaccaaaacgggccatgatggcttggacaaattcaacaaggcgctctgcctcacttcttacttttttctcctccatatgtgaaaaggctgcttcataaagacctggatgttcgcggacaaattgaacatactgtttggcaaaggctaacacagcttcttctttatccagcccctctgttacgtgtatgccttcttcacgtagcatggacagccctttttctgcgagtgccgcctgaatttcatgaagaccagatacatgattataaagagagggtggtctgatgttcagtcttttagacaatgtagcaatggtcaaagcagaaaaaccctcttcatcaacaaatgtagctgctgtatcgatgattttttcttgcgtgattcccattcttggagacacggtttactgctcccctttcttcagctgctgctgcctttttcgaacggcagcttgaagcttttcatgaggttctataatgagatcgccatgtcctgcagcaagacaggataggcgaagtgccagtaatttttcggcgcttttgagtgcggtttctgcatcccatgtagcaaaagccgggaaagggaaagaccagcgaaattcacccgtaacagataagccgccttttgtcacaagggcatccccagcaatcacaacttttgatctttcttcgtataaggatatgctgccaggtgtgtgccctggtgttgcaatgactttcagcggtccaatctcatccccttcttcgacaagcacatccggttttgtacgaatatgtttcgaaaaactgcctttgattttttgctggggttcgccaggaagtaaggacaagtcaccctcaaataggcgggcatcgcgttttgataaatagacgacagcctctggaaaaacctttttcacttcatctaatgcaccgatatgatccatatgactatgggtgagaatgattttgtggatgggcttgttcttttgtcgagcaaattcgatgatcgagtttgctgccatttttaacgcagcatcaattaagatcagtccattctcttcctcaaaaacataacagtttaccgggaataatctcggcatcaatgtgagctggtgcagacggtcaaaagttgtcaatctcatcaagtgtccccctaaaactaatattgttagttttatattaactaatactattagttttagcaagcatttcttcatcaaccgcaatataaatatcaatttgcgcttcttttggatcaatagatctttcgtcataccattcaaagtcgcctgtatatgtgcggtaatggcgctcatcccacgtccaaatctgctgccatgtttcccacacgacctcttcaatcggaccctttctcgttcggaattttacgtaggcggaggcaggaatctctatgatatgttctaactgctgatccacgaattgcccagcagtaaataaataagagccatgctcatctttttcataatctgaatacaatcctatgacgggcgcttgccctccgtgaagctgctgcgcaaaaaattgctgccagagtggagcaatcttccgctcttttgtttgctccatttcgtttgttgttcgaacagacagcccttttatccattgtttctctaatgtcacgatatcgtacatacattctcatctccttttttctatcatataaaaagaaacctgacaacattgtgtcaagtttctattcgtttgagaaattgtttcagctggagatcaaacccttctttgacatgcttcggagaaagaatgtcaacatctggacctaaatggaataggaaactatttaaccaatcatcaagaggtactgtgatggtggcaagataggtaccgtctgaacagacgttcaattcgttctcatctacccattccttcactttccccactgatgcttccgttaacctgagcatgactgggctgacagacggctgttcttgccaagaatcattccaaggcttctcttcgtttttgactcttttcggttgaaaataccctgaaatggtgacaagatcggtcattctagtcagcttgaacaggcgaaaagctttttttacacagcaaaacgcatacaaataccaatgcctcccttttaaaacgagcgtataaggctccactttgcgcgaaagagtttcacctttcgcattgcgataagtaaactgaatgtattggtgcgctgacgcagctgtatgaatgagctggagcttctgctctgcctggctgtcttttccccaggagcttaaatcaatgaagacatggtgctgtttctcgccttcatcagtatgcggggcaatgagagatttgatttttttcagtacatgttcactttctttaaaggagtatgcacttgtcatgctttcaagagctgttaaaatgacttcgatgtcatcatcggtaaataattttttctctaaacgatagtcctcaacaagtgaaatgcctccacctgctccttgggttgtcacaacagggattcccgcttgattgatggtatcaatgtcacgataaatggttctcgtgctcacttcgtgaagttcagcaagatctttcgcctgtacttgcttcttgctaatgagcagcatcacagtagataaaatgcggtcaattttcatgacttttcctctttttcataaatgtaggttttgttttgataaaaaaagaaagaatggtaaagataagtaacagacagcattcgtttacatccctgcacgtgcaggaggaggttgcatcatgacacataacgtgtggcaattgttcatgattgggagcattatgttgatctgcatcatgattcgaatgaatcgaatgagacgctatcagcttgtacgccccatcaggcttttgatgagaatgtatctctttggtctttcagcccttattctcctatcagaaggatggcaaaatcacaatatcttgatctatgccgctattggtatactttttggaagcagccttgctgttcatgcctatcagacgattcgtatgaaagaagaaaatggccggctgtatatgaaaacgagtaaatggattgaaagcttcattttatgcttgtttttatccagggttagttttaagctggttgaactgacaaaccattcgatgaccaagatcagtgtcgttgaactgtatcagcatatcgtgagcgatgatgcgatgaccatgctcagctttttccttttagcggcttactatgttgtcttttcttttcacatgatgaaagcaagtaaacgatcgacacatgtacatcatgtataaaaaccttcctattggcgtaggaaggttttttatcaatcgtgctgtgcatgatgaatcatctgttcaagcacttccattacatgctgatcttcaggactgtaaaaaattgaggtccctgctcgtctagatttcacaagacgaagattttttaaaaagcgcagctgatgagaaacggttgattgcatgagattcagtgtttctgctatatcatttaccgagtgttcaccttgagacagcaggtgcagaattcgaatacgtgtcggatcagataaagctttaaaggtttgggagacaagaaatagactttcttcatccagctccatccgttcctgttcttgatttgtattcagttcttccttcattttgcttcacctttcttgtccgtcaaatcacgacttattctatgtatcatcatataccaaaacgtccggcatgcaaagagagcacactttagaaaaaagatttactcaaatagcattgacacttggtagcattctttttaaaatgagcattatttattcatttttttagaggagctgataggcaaattgactgaggagccaagactaaaacgcagcctgactgtctttccacttgttgtgatcgggcttgcttatatggatccacttgtcgtatttgattcatacggcattgtggctcagctgacgaaaggacacgtcgctgcagcttatatatttacgttacttgcattactattgacagcgcttagctatgggaatatggtgaaggcttttccaaaagcaggatctgcttatacatacgcgcaaaaaagtattcatcctcatattggctttcttgtaggctggacacttttactggattatttatttttgcctatggtgaattttgcgattggaagtgcttatttaaccgcagcctttcctgatgtacctcattacatttggatcatcatacttgctatcgccataacgactgtcaatgtaatcggtatccggcttactgccaacatcacggcactatttgtgaccttccaggtcattgtcgccgtcacttttgttgggtttattatttatgggctcacgcaaaacgcaggcagcggagaattattgtccgcccggcctttttattcggcgagcttagatccagcgctgattttttcaggagcaaccattttatgtttttcgtttctaggatttgatgccatctcaaccatgtctgaggaaaccattaagccaaaaaagacgatcccacttgccatcttcttaaccgtcgccattggaggcgtactttttaccttgacgtcttattttttgcagcaagtatttccaaattttcagcagttcaagcatcccgatgcggcgtcacttgaaattgcggaatttgtgggcggcgcctttctccactcgttctttttagctggcacaatggtcgctgttatctcttcttccttatcgtcacatgcaagtgcagcaaggctgttatatgcaatgggtagagatgagtcgttaccgaagcgtttcttcggatatattcatccgagattaaaaacgcctgtttttaatattttattaattggtgctttctccttaaccgcagtcgttggcgaacttgaagtcatttattcctttatcagcttcggcgcgttgattggattcacatttgtgaacttatctgtttttgcgtactatttcattagacaaaaacaaagaggtgtactcaatacattgagatacgcagtgatccctctgtgcgggacggccttttgtatatggctgttaacgagcatcagtacaaatgcattaatcattggtttgctttggctgattatcggttttgtttatttctgctacagactgaaaacaagacccgaatttacatttgggtacgattgattataaggttttcacttggtatcttgtgcaggatatggcataataaaaaggctgtacttcccttttaaaagcggggcaaaacaggggtgaactgaccttgaaaaagaaaaaaacaggatgttttgccatttcaggctgcttcacgatttttctgtttgttttcgtattagcagccattgtcatgtcctttaatcaaaaggagttaaaaaagctgccgattgatacggaatcaattgttttgtcgagattggatgatttcaaaccgcttgtagaaacagagttaagagatcaagatttagatcaatataccgcgttaatcctcggtatgatgtatcaagaatcaaaaggcagaggcggagatccaatgcagtcttctgaatctcttggtttgaaacgaaatgaaatcaatgaccctcagaaaagcattagacaaggagtccatcatttttctactatgtacaagcatgggaagaaaaaaggcgttgatttggaaactattatccaaagctataatatgggaattggctatattgattttgttgcaaaaaacggtggaaaacattccgagaaattggcaaagcaatactctaaaaagcaagtgaaacgaaacccagaagtctatacgtgcggaggcaacaaagataacttccgctacccatattgcttcggtgacttcacttatgctgaaaaagtaaaagaaaaaacgaaaacagttgaagaaaagatgaaattggcttcgtcatcctcaccatcttcgtaaaaaaagcacttcctctatggaagtgcttttcattttatcgatgttctttcccgatttccggcaggatcgttttcgctaaatgctgatccatttcctcatattcatcataatgaatcgtttcatacaactcttgtctcgtttgcatgtcctttagcattccttgctgcgtccccttctccatgatttctgtaaataaacgctcatacgcttttgcagcgactcttagtgatgacacagggtaaatgaccatttgaaaaccaaatacagaaaattcgtctgcatgataataaggcgtcttgccaaactccgtcatatttgcaagaagcggtcctttaatattgtttgacgcatgcgtgaagtcctctgctgtgatgagtgcctcaggaaaaatagcatcagctcctgcttctacgtaaagattggcccggtggatgacatcctctatcccgtttacagactttgcatcggttcttgcaatcaccaaaagcgttggtgccgcttgtttaatggctttgatttttgcgaccatttcttctactggaacgagtgattttccgtttaaatgcccgcattttttcggcatttgctgatcttcaatttgaacagctgccaccttactttctaccatttcctttgccgctcttgcagcattcaatacaccgccatagccagtatccatatcgaccaaaagcggcagctgagaagctcgaatgatttccttcgctttttcagccatttccgttgaatgaatcatgccgagatcaggcaatcctttgctggcacaaaaagcggcgccggataaatagagcccttggaagcccattttttttgcatagagcgcagacattccatcgtgaacgcctgggatttgaaataaagctgatttgtgcatttgttcttgaaaggctgcggctaaatctgcttgacttgattcatcattcacgatccacacactagttccctcccttatatgacgaataggtccataaatgctggtacggttgttgtttttaattgatttgggttttgacagagtgacacaatttgatccacttgtttttgtggaaatcttgtcttcaaatgataaagccatttcttttcaagcagaggaatgccttcctgccttcttctgcgatgaccaagtggatattcaatttcaattcggtctgtcatcgtcccgtctttaaagaagatctgcacactgtttgcaatagatctctttttcggatctaaataatccgctgtatattgtttatcttctttgacaaccatttgatcccggagacgatcaatggccggattttgcgccgtttcttcttcataatggtcagcagtaagctcaccatagatcaatccaaccgcagtaatatattgcaagcaatgatctcggtctgctgggttatacagcggtcccttcttatcgataatccgaatcgctgattcatgtgttgtaatctctactcggtcaatttcatctaatcgaccttttacagcgtcatgcaggatcatagcggcctctgcagccgtctgggcatgaaactcagcaggataagcaattttgaaaagcacattttcgatgacgtatgatcctagcggctgagcaagtgtgagagatttccctttcatcagaacatcttcaaagccccacttctctgcactaagcggcgtttgatagcccatttccccttttagcgtcatcattgccagtctcaccccgcggcttgttgcatcacccgctgcccacgatttcctagatcctgtgtttggggcgtggcgatacgtcctaagcggtgaattatcaacaaacgcttgtgataaaacatgctggacttcttcctttgttccgccaagcaatgcacacacaacagcgctagttgctactttgacaaatagcacatgatccaagccattgcggttcagacaattttctaaagccagcacgccttgaatttcatgtgctttgacgatcgcatgcaatacgtcattcatcgaaagcggctcttctccgtttgcaagacgtgttctgctgatgtaatcactcacagctaatattccgcctaagttatctgacggatgcccccactcctctgcaagccatgtgtcattataatctaaccagcgaatcatacagcctatatcaaaagctgcttgaacaggatctagcacaaaggaagtgcctggaactcttgctccgttaggtacaacggttccaggtacgatcggtccaagatgtttcgtacattcaggaaaattgagcgccagcattccgcagccaagtgtatctatgagcacatatcgtgccgtttcaatggcttctttactcgtaatttccccatctactgcataggctgcgatttcttctaatagctgatctgtttgattggcgactgctgttttattcatgatcattcccccgtttttctatcatcatctgaaacttttaatcctcttggccctaaataccggactctcggtctgaaaatgcgattatgcaaatgctgttcaatgacatgagtagctaatccacttgcccttgcagcaaagaaaatcggtgtataaagtgaaattggaatcccgagcacgtaataaataggtgcggcgtaataatcaaggttcggatagaggtttttcttctctttcatgtatgcctctcctgctacacacatgtcataaagcgttgtatctccctttgattccgtaagcgttttcaatgatcgttttaaaagagcagctcttgggtccatttttctcatgtataccctatggccaaagcccatcattttttcctttgcggctaattttcgctcaatcagcgcaaggaagccttccgttgtttttccttcgagaagcatatgcatgacagcttcattcgctcccccgtgcaagtcaccttttaatgaagaaattgctccagtaaaagcaccatacatgtcagaatgtgtggatgcgatgactctagcggcaaacgttgaattaggaagctcatgttcactatataatgtgagtgtttggtcaaaagcagtgatttcgtcttgggttggcgtgcgtccggttagcatggttaaaaaggtttcagtgtaggatttggtctgatctggagaaatagcggcgtcttttgtgagaatatgatagcttccagcgacaatcgccggcagctggccgagtaatcgaatagcacgcttttgctggcacgcttctgatcgatcttgtaatgcatcatcgtacccactaagagcagatatgcacgttctcatggcgtccatcggatgagtggtttttggcagttttgttaaaatggattgaatggttggatgtaagttggtttgtgaggaaatgtcttgctgaaattggtgatattccatggcatctggtaatcttccataaataagcagataggctgtttctaaataggtctttttttgtgccaactcgatgaggtcatacccgcgaattacaatctcttcttgctgcacatctaagtatgagatagacgtttcgcttgccacaatgtcttcaagccccggtttatactgcatttgtttagtcatcatataacccccgtttcgttcaattgttgttctccaaacgagcaaacggccagaaatgatgtgagtctatagatgggaagataccgtgcaagtcggatacccaattcccattttatccaaagcactgcatcttgtaaataaaagaacgtatgtccagttggacatacgttagctgtagtatggagaaatcatcatatacacaatgacgccagtgagactgacataaagccatagcggcattgtccagcgagcaattttacggtggcgctcaacttgcatctgtgcgcctctaaacagcgtaatcagggcaagcggtacaatgactgctgataagacgatatgtgtgattaaaataaagaagtaaatcgggcggatgatcccttctcctccgaaatgagtatctgctgccattgaatgataggtgacatacgaaattaaaaagacaagtgtcgttgaaaatgcagcaaagataaatcgtctatgcgctttaatgttcttttgtttaatcatgataagtgctgaaagtaaaaagataaacgtaaagctgttcatcacggcattcagtaacggcaaaaatgtaatatccagatgactaaatttatctgattttggcattaaaaataataaagcgattaatccgtttatggcaattgttaaaatgatcacaataccagtgaaatttttcggtttttgattctgttctttcatgtttgaaaacctctctttattagttccgactaagagtatgttatttaaatttctcgataaagtcaatgaattcgctgtcttcgtcgaattttagacaaacttgcaggttacaggtgttttaacggcttgaaagatccatccacttcctttaaaattggaatttatgtgatttttatcatttctgataggaaaggagtaatggacttgtcaatcttacaagaaacagccaaagatgtgaagacattagagcaagaattacagcaattgcagttccaaatgtatcgaatgcaagaaaaaatgaaagatatttcgaaaaaagcaaaaatcattggcatcgatcaagcgaaagaagatgagtggctgatcgtctctgccattgaaaatgcagatacatgtaaaataatgctcagcgattgtgaaaaagcttttcgcggacaatctgatttttccttaattgcggaatatcctgaagaaggaaagattcatattgccgatattaaaggcccgccagataatgggtacggctctatctgcatgaagcatttaaaagaaattgcaagagagcagaacatcccagtgattactggcgacctcgtcaaaagagactgggatcacgtggaccgcttaattcatttttatgaaaagcatcaatttgatgtccagatcaattggaaagaacaaagcggagaaatttattgggttgacagctaacgacacaaaaaccagcgttgtatgggcttatacgctggtttttgtcgaaaatgcgaatttttcagaaaaatatgtgtatttctgaccaaaaaaaggtataataaaagcatcaggccgccacctgatgctttcttccaaaaaacaatagactactagttaagtacttttactttgactgattttacgccccaatttttcgcttgggatttgcttggtacatgtacatcaattttattacctttaattgcgccgccagtatctgctgcgatggcttcaccgtagccttcaacataaaccttacttcctaatggaatgacgttaggatctactgcaatgacttttgcatttgggtttttgtttaagtttacccctgttgcagtgatacctgagatgccaccatcatttgctgtataggccgtagccgttacagtcatttctttttgtacactttgactagcagaagatgattctgctttagctgtttcctttttaggagcagcttttttcgttgtttgctctttttggacaggtgcctgtttttgaacaggttctgagcttaccggagctgagctttgaccagcaacacttaatgttgaaccaatcataattatatctgagtttaagttattccaagacttaatatcgctaattgacacattgaatttttgagcgattttccagaggctgtcccccttctggactttgtactgctcctgagttttctcttttgaagagattgtcaatttatctcctacatagatcatgtctgtagataaattgttccaaccctttaggtcctttagagacacatcatttttttgagagattccccaaagtgtatcacctttctgtacagtgatttcctttgcagaagcttgctgtgctcctaatgctgttgttgagattgctgcaacagcaaccaaggacataatagtcttcttcataaagtaaatcctcccttgttagctttttatggcggctaacgagtgctatcgtaacatatgtaaatgtcatttcaataacaaaacgatatgttttagattacagttcctttacatgaaacatctctctccattggtaaatcagaccacaaaacggcttgattccccgccatatcaaggttttaaaaggatcaaaaacagcttgatgaaaacgtgtccaagtgcagcgaaaaaaatttatttttcttcttcaaaccttttattttttctctttttctataaataaacgaatttcttctaaaaaaacatctccgtatttctctcttttttgagcgccaatccccttaatttggagtaattcttcatctgtttgaggctctaccgctgacatttccttcaatgtttgatcagaaaaaacaacaaacggcgggacaccttgctctctagctagcttcattctcagtgctctcaattgctcaaataatgcatcattttcttgaatggcttctgctttgatctcctgctttttatacactgcctcttgtccaactagcactttcttccctttatgggtcaccttgagtgttggataagcaccttcagacatgtgcaaatactcttctgtaattaaaaattcaatgaagtcactgatttgctgagtcgaatgttgtttcattaaagcatatgtagggagacggtcaaaacctagctctagcacttttttgtttttagagcctgccagtacttgggcgatcatcattttaccgaatcgctcattcattctcactgtacaagataacaccatctgtgcttctcttgtgacctcttcacgctctctttcatcaaggcagttgctgcatttaccgcaaggcgaactagctgtttgatcaaaatagtccatcacaaattgctgcaaacattgctcagtatgacagtaatccaccatttgccttagtttaaacagctcatgctggtagcgcgtctcatcttctattgactgctcaatgagaaagcgctgcactcttacaccttgaggtgaaaacagtaagatgcattcactttcaagcccatctctgccggcacggccagcttcttgatagtagctttcaatatcccttggaatttgatgatgaatcacaaaacgcacattcgacttattgattcccatgccaaatgctgatgttgcgaccatcacctggatgtcatcatttaaaaagaggttttgctgctcttctctcgtatgatcatccaatcccccatgataaacgccaactttgatcttttgtttttttagacgatgataaatattatccgcttctttacgagtggcggtataaataatgccagactcaagactgtttttcttcatatattgtgtgataaaacgttcactgttttctcctttgatcacttgaaaggacaaattttctctagcaaacccagtaaagatggtttcttctccgtttataccaagctgttcacatatatcttgatggacctttttcgtcgctgtagctgttaatgcgacaatcaccggtctttttgacagcttgttcaagcattcttgaatgaagcgataacttggcctaaaatcatgtccccactcagatatacagtgcgcttcatcaatcgcaattaaaggaatcgttaaccgatctagcagctgaaaaaaacgttcattttgtaagcgttcaggtgtgatataaagcagttcatattccccattttcgcattttttcagcctttcattcatttcagctgcggacagggtgctgtttaaaaaggaagaacgtatgcccatctcatttaacgcatcaacctgatccttcattaatgaaataagcggagatacgacgatcgttgtaccttccatcattagtgcaggaatctgatagcaaactgacttccctccgcctgtcggcataatgcagacagtatccttttgtttatttacaattgcttcaatggcttgtttctgtccttttctaaaggcatcaaagccataatattgtttcaggagtgcttctgcttgttctaacatccaattccctctccgtcatttgttttgtccattttaacacagattcttgcctctacaggcgatcagtctaatttcgtcttttcacaaaataaaaagccattttccgaaatggaaaatggcttgaatcatcctaggaaaagctgcggatgccgtaatctaagtaagaaagttttaaaccaccactcctcaaagtgggtgtttgcagaaacgttcctgtcttcctctctaaggaggcatgacattccggcttcaatataaaactccctattacagcttaaaggttaaaacttaattaacattacgcgcatcgcagcctttaaactatattacacgaaagtttattaaatttcaagagatcttttttctatgaaagactcgtgtatacaagagatttgtccttgtacatataagaaaaaattattctgaaaaaatgtaaagttcactaattatcctatttttcttcgtctatgtcaacatcctgctcttcctctaatcgttcatacgtatctgaatgcatctgatccattgtttgtctatttgttaaatcacgcatttgatcagagaaattacgatcaaactcgtttggatcttgagtggtttcttcgtttttcttcgcatcgattgaataacgtgtatagggaactgcttttaaacgttcatatggaatgtctttccctgttttctcacaaatcccatatgttccgtcttccattcgtttcagtgctgcatcaatttcagcttcaagctggccatcaacttggtccagcgtttgttcggtcatgcggtctaaatagatgctcccatgatcagcgatatggttcccaacaccatttgaaatctcgctcgattcacttagcatagattcttctttcttttttgacccttttacatcttcctttaattgattcaatctttcgtataaatcagctttttgttctttcgttaagcccacggtcaatcactcctttcttattaccttcccgatgctaacgaaatgaaaacatcaaaaaagccgctgcctgattggcagcagcctttcttctcttacaggatgcgaagtgcttcttctactggcttatcccctttaattaagtcaaaggatttatttttcacattggattctgttaagctttccacaagtacagcggctacgtcctctcttgaaatctcaatgttttgatcatctggaatatgctctgcagcttcgatctttcctgtcttttcctcatgcagcaaggcacctggacggacaatggtataggaaagcccagactgttttaggtgttcatctgcttttctttttgcctcataataaatttccatacttccttgcccttttccctggtttggatcatcggcattataggaactcagcatcacaaaatgctgaatattttcttttttcgctgtgtcaacaagacgttttgctccttcttgatccactgcaatcgtcttatctgcacctgtttttgagcctgaaccagctgcaaaaatgacagcatctgcttgtttcacagcatctgtcacatcctgttcaagatcaccgatgacaggcgctgcaccaagttcttttagcgcatccgcttgtttttcatctcgaataagagcaagcggctcatgtcctttttcttttaaataacgaataacgagtctacctgtatgtccatttgctcctgcaactaatactttcattgttcattctcctttctgtatctgtttcatctttatccttttttgctatcattcaaacacctaaacaaaaaagcccttcccagaaaatatggggaagggttcaggaaatgtgcgatctatgaaaataaatacgaagaatgagaaaagtgcatgtgatctatgtaatcgcaaggttgatcagcaaagatgttttgtcaaaatggcttgcacatcactcaaatccgtctctttcgaaaaatcgagttcaaatacttttgagcttgtgacaagcagcatacctgtgtcctgatcaaacacgccagcttcttgaatggcaaaactttcaattgatcgatacggcaaggagaccctgactttcttcttagaaaatacgcggttatcgccaaagatcagtcgtttattggtgaaacaaatttggtcgtgacgcagtctgtaaacagcttcaattctctccccttcaattagtaaggattcgaatttcttatcattttgtttactgacagaaaaaatacccacgtaaaccccctcttcctccatcaaattcctttatgaaaaaacggccacacgctctgtggatacgttttgttctcacttatagaatacgctataaatggtcgttattccattacgaatagattaaatttcatttaactttttctttttgattcgatgctctttcctctacttatttagacagttaaagcaggaaaaaagtttcagttctttttgagaaaaatggttgaattgtgaccaataaaaaaacagtgattttttcaaatcactgtttaaaatgactattcgtcttttggtgtttcaatggttccctcggcatatacatcggaaatctgctcaagcgtaattgccatatcagcatcttcgttatcatgccaagcattttgttgattctgctcatctgtttgcttctttttcatcatcatcaccctttactgtttttcttagtatgagtgatgatcaccaaaatcattcagcagaaatggcttcgaaatactctttataatacccgcctactttacctgtattatcaacgacaaacaggaattcttctgtttcatttttcacttcatatgtgcttccagccgttagtgcacggtcgaccatatattttttcgcattcgtatgtatacattttacttgttttaacgtttgagctgtttgccagttttgatggatcatgatttaaaaactccttttttcatctatacatttattgtagccaatttttcatgaaatgcaatgagtgttatggattgctttcaaacatgtggtgtaatatgatgaatgtatacgtttacatccatgtgcgtatactagatcatttactcaaatccgctttttcacctagaactcgcagaacaacccatatctttaaggaggtttgtttatttatgagctctacaacacttcaaattagttcaaaactcgaatcttttctccaagggacgaaaaaactctacattaatggtcagtttgtcacaagtcacgataacaaaaccttttcaactcctaacccagccacaggtgaaacccttattgatgtatatgaagcaggtgcaaaagacattgatgaggcagtaaaagcagccaaaaaagcctttcatggtccttggcgctccatgtctgccgcagaacgtgcccgcctcatgtttaagcttgccgatttaatggaagaaaaccaagaagagctcgctcagctcgaaactttagataacggaaagccaattaatgaaacaaccaatgcagacatccctctcgcaatcgagcatatgcgctattatgcgggctggacaaccaaaataagcggacaaaccattcctgtcagccaaggatattttaattatacccgtcatgagcctgttggcgttgtaggacaaatcattccttggaacttcccgctgcttatggccatgtggaaaatgggtgctgcacttgcgactggctgcaccatcgtgttaaaaccagcagaacaaacacccctctctgcgctttatttagctgaattagtagataaagccggcttcccagaaggtgtgattaacatcgttcctggattcggtgaaacagctgggaacgccttaaccgatcaccctgatgtaaataaacttgccttcacggggtcaacaagtgttgggaaactcatcatggagaaagcagccaaatccattaagagggtcacattagaacttggcggaaaatcaccaaacattattttgccagatgccgatttaaagaaagctattccaggtgctttaaatggggtcatgtttaaccaaggtcaggtatgctgtgcaggttctagggtttttgttcaccggagccaatatgatgaggttgtcgatcaaatggctgaatatgcgacatccctcaaacaaggagctggtcttcatcaagatacgcaaatcggacctcttgtcagtaaagaacagcatgagcgcgtgttaggctatattgaaaaaggtaaatcagaaggtgcaacagccgttgtcggtggcgattgcccttatgaggctggttattttgtctcccctactgtttttaaagatgtagaagatgacatgaccatcgcaaaagaagaaatctttggacctgtcctatctgcaattccttacgattccattgaagaagtggtcgaaagagccaaccagtctgactatggattagcagcaggactttggacagaaaacttaaaacatgcccatgatattgctgcacgtcttgaagcaggcacgatttgggtcaactgctataacgtttttgatgctgcctccccgtttggaggatacaagcaatcaggtcttggcagagaaatgggatcatacgcccttaacaactatacagaggtcaaaagtgtgtggattaatctccaagactaatgacgcctttaaagccggtgaccatgtcatcggcttttttgtgattgcatgtgacaggcaggctcctgaatatagtaataaaggaaaggagcatggccgaatatgcaagatttcaaaatgaaagtaaacgaatatattgatgaattgcacatgcaactacagcacagacaacgagaagatggcgcttttgtcttctgctttgaagggccaatgatgacaaatgcttttttgattatgctcttaaaggctgtcggcgattcggatcaggctttggttcatcaattagcagaagcaattcacgaaaagcaaaatgaggatggttctttttctttgtatcatgatcaggcgggacatgtaaccgcgactgtgcaaggctactgcgggatgcttgtgtcaggcaggtatcaacaagatgagccgcatatggaaaaagcagcacattttattcgatcaaatggcggtctgaaggacgttcattttatgacaaagtggatgcttgccgtcaatggcatgcacccttggccatacttctatgcaccactttcatttttactcatccctacatacttcccgcttcacttctatcatcttagtgcatatgcaagaattcattttgtcccaatgatgattgcactcaacaaacgatatacctcacatgaacagtttccaagcctagcacatcttgatgcaaacatgtctaaaaatccttttgactggtttatggcaagagaagaacgttccacccaccaatttctagcatacatgcggtcgtatacagcactcgacagacggttcgactttttcgggtatgaggcagcgaagaagtatatgtttgaccgccttgaaaaagatggaacgctgtacagctatttaagtgccagtatttttatggtctatgcactcatgagtcttggatactctcctggacatcatctcattttaaaagcagtcaaagggatgaaacagctagtcactgactgcgggggcatgaaatatgctgagaattctacatccactgtttgggatacagcccttgtcagttatgcttctcagcgggcaggcagagcacaagttgatccagtgatcaaaaagtcttttacgtacttactgaacaggcagcaaatgaagaaagcagattgggcggtccataaccggcatgcggctccgggaggctttggtttttcagatttgaatacaaataacccagattgtgatgatacgcagattgtgttaaaagccattcctcaaacttacgctcccgttcagtggaaacgaggatttgattggcttctttccatgcaaaaccgggatggcggcttctcagcttttgaaaaaaatcaagatcacttcttgcttcgtcatctcccgctcgaatctgctgaggacgcggccattgacccttctactcctgatattacaggtcgtgtgcttcatcttatcgctcttgaagatagcagcaagtcaccactcatgcaaaggcaaaaagatcattgtgtgaaatggctgcttgatcatcaagagaaaaacggatcatggttcggcagatggggcgtttgctatatttatggtacttgggctgcgttaacaggtctaaaggctgctggcatcccctcatcgcatcctgctgttcaaaaagcatgtcgatttttaaaaacaagtcaattagaagatggcagcttcggagaatcgtgtaaaagtgcagaggttaaaagatacgtcccgcttccatttggaacagtggttcaaacagcttgggccgctgaggcacttttacaatacgagcagccagatgacaaagcaattttaaaagccatctcatttttgattcaacatcagcactcgagtgaagccttacactatccagtaggcattggtcttccaaagcaattttacatcacctatcatagctatccatatgtctttccaatgatggcttgttccacatttttagaagaaatgaggcgtaaaaatgaataaggaagaatatcgcatgcagcttaaagattggcttagctccattcaagatgcaattcaagatgacaacctccgtcagaaagcagaacatttgtcgttcatcatgaatgatgaacattccagtgaaaaggagtggtatgaattagctgagagtattgcagaagatataattccacaagatgctactcgggatgtggcaactggcggccacaaattaccccctctcccttaccgctatgatgcactagaaccgtttatttcaaaagagattatgtatttgcatcaccagaagcatcatcaatcatatgttgatggtctgaaccaagctgagcttgccttaaaaagagcgagaagaaccaatgattttaaaatgatcaagcattgggaacgggagcttgccttcaatggtgcgggacactatttacattgcattttttggttttctatgagcccttcaggcaaacgaaagcccactgggcaaatgcttcgtcttattgaacaatcatttgaaagctatgatgcattcaaatcccaattttctgctgcagccaaacaagtagaaggtgttggctgggcgattcttgtttgggcgcccagatctcagcgattagagattttacaagcagaacgccaccaatttttatcacaatgggatgtgatccctcttctagctcttgacgtatgggagcacgcctactatctgcaatatctgaatgaaaaagcgacatatgtagatcgctggtggaatgtcgttgactggcgtgagccagaagcacgacttaagcaagctcagcaagtgaaatggaccccattttaaaacgctactccatgtaggcatatgcttatatggagtatttatagtttacataatattattatcagaactaaaagaatggggttgttttttcagaaaattcatttaaaatagaaaagatatgtaaagaaagagagttgaagcaatatatgaagattcttttaactattagtcactttgcaggtaggacctttgcgatttgggttcttgtctttgcgtttcttggatttgcctttcctgcggaattttcaaaaatcggaccttatattccttttttactcggtatcattatgtttgggatggggctgacattatccgctgaagacttcaaagaactgtttcgaaaacctctttatgttctgatcggggtactgacgcagtacacactcatgccgcttctcgcctttttgttagcgtacggactaaggctcccgtccgaaattgcagtaggagttgttctcgtaggctgttgcccaggcggtacagcatcgaacgttatgacctttttggcgaaaggaaatacggcattatctgtagccgtcaccaccatatcgacccttcttgctccctttttaacacctgtctttattttactctttgcaagatcatggctacctgtatcgccggaagcactatttttgtcaattgtacaagttgtgttgatccctattatcttaggcgtcatcgttaaattatttttcaaaaaacaagtaacctatgcggtacaagcattaccgcttgtgtctgtcgccggaatcgtagtgatcattgcagcggttgtcagtgcaaataaagaacagattcttcaatctgggctgctaatattggccgttgtgatcttacataatggacttggtcttttatttggttaccttattgcaaagtggtgcaaaatggatatcccttctcgaagagccatctcgattgaagtaggcatgcaaaactctggacttggtgcagctttagcaacagcacacttctctccacttgcagccgtaccaagtgccatttttagtgtgtggcataatttatccggttcctggcttgcgacatattggtcaaaaagaggaaatgctgaaaatgaaaagaaaaaaagctagcacccattaaggtgctagcttttcaaatgaaagattatccttcaagcaatagctgctctggatcttcaagtaagtttttaatcgtgacaaggaatccaactgcttctttaccatcgacaatccggtgatcgtaagaaagagctaaatacatcatcgggcggttctcaaaacgttcttcatcaattgccacaggtcgaagctgaattttgtgcatccctaaaattccaacttgaggactgtttaaaattggtgttgaaagcagtgaaccgaatgttccgccgtttgtgatcgtgaatgatccaccttgtagctcatttagagacaatttgttatctctagcttttttcgcaagatgaccaatttccttttcaatccctgcaaacgacaatctgtctgcatcacgaacaaccggtacgacaagtccttcattagcagcaacagcgatgccgatgtcatagaatttcttcaagacaagctcatcaccttgaatttctgcgttaagcagcggatatttcttcagcgctgctacaacggcttttgtgaagaaagacatgaagccaagttttacatcattttgttcaaggaaggcatctttacgtcgttttcttaagtccatcacagccgtcatatctacttcattaaatgtcgtcagcattgcagccgtttgctgaacctcaactaaacgtttagcaatcgtttgtctgcggcgcgacattctctcacgttcaactggctttccttgttgttcattttgcaccgcagcatttgcttttggcgcggcttttggtgcacttgcaggtgcttcattcttttgataggaagcgacatcctgctttcgtaccctgcccagcggatctacggttggaatttcagataagtctagtcccttctctctcgctagttttctagctgcaggagaagcgatggttctgccattaccagatttcggctcttctttcactgcttcttctttttgagcagctgccggttcatctttcggagctggtgcagactcttgctcaggtgctggagctgcggactcgcttccgccagcttcacccgctgcaattgttccgatgacttctccaacttgtacagtgtcaccagaatctttcagtacttctttgagtacaccagattcttcggctgtcagttcgacattgactttatctgtttcaagttctaacaggtattctccctgctccacataatcgcccggctgcttgagccattgagctatcgttccttccgagatcgattccgctaattcaggtactttaatttccgccatttttcatttcccccttagtttttgcgagtcaagctatcagatacaattcgttcttgttcttttttatgcacagttggatcaccctcagccgtacttgaacgtcttcttcggccgatgtaacgtacttttactttttcaggcgcaatttcacgtaaatatggctcaatatatccccaagcccccatattttgtggctcttcttgtgcccatacgatttcttctaagtttgttagttttgataatatcgctttaatatctttggctgggaatggatatagctgttccactctcgcaatgtgaagccaatctttcggctcttccatttgagtaaagcgatcactaatatcgattgataccttcccgctagatagcacgaggcgcgatactttttcgtgatcatgcacaaggcctggttgttcaagaactggttggaactgtccatccgttaattcctggacttcagacaatgtgttcgggttacgaagcagactcttcggtgtcatgatgacaagcggacgaatctcttcacgaagtagcattttcgcctgtcttctaagaatgtggaagtattgcgctgcacttgtgaggttcgccactgtccagttattctcagcagctgattgcaggaaccgctctgttcttccacttgaatgctcaggaccttgtccttcatatccatgaggcaagagcatcactagacctgatttttgtccccattttgcgcgtccagctgaaataaattgatcgaaatacacttgagccgcatttgcgaagtctccaaattgagcctcccaaatgactaacgtttcaggagaatagacattataaccatattcaaacccgatgactgagccctctgacagtggactattatgaacagtaaatgatgcgtttgcatcactcagctcatgaagagcaataaattcatttccagtttgactgtcgtgaagaacaaggtttctttgagcaaaagtaccgcgctctgaatcctgtccggtcatccgaattggcgtaccgtcttttaatatagatgcaaatgcaagtgcttccccaagtgaccattctactttacggtcatctgtaaacacttttgcacgtttttcaaggatccgtttaagcttaccaaatacttggaaatcgtccggccagctgatcaattcttcattcagctttcgtaatacatcaaactctacggatgtatccactgctgggaagccatttgatactggttctggcagttcaatttcatgaatcgtatgctctttctttgaaggcactttttgataggcttcttctattcttgtcgctacagcctgctcgatttcttcacgctgctccttcgttagaagaccttctgtgacaagtttatctgcaaagatattcttgaccgttttgtgctttctgacggcatcgtacagcatcggctgagtcgtagaaggctcatccatttcgttatgaccgtatctgcggtaaccaatcaaatcaattaagaaatccttcttaaagcgtttgcgatattctacagctaattgaacagccgctaaacatgcttctggatcatctgcattgacgtgaacaattggaatctcaaacccttttgcaaggtcacttgcatatttcgttgagcgagattcattactttccgtcgtaaatccgatcatattgtttgcaatgatatggattgttccgcccacttgatagcctacaagttgacttaaatttaatgtttctgccacaattccttctccaggaaatgccgcatcaccatgaattaagatggctagagccttttcaacgtcttgtactggatagcccttttgagtacgtaattcctgagcggcacgtgtgcttccttcaatgattggatcaatgaattccaggtgacttgggttattagcaagcgtgactctcgcactctttgtatcttcgtctttaatttgacgatctgctccaagatggtactttacgtcacctgtccacccgtagctgatgccaatagagccttctgatggaacaagctctttatttggcgcatgctggaattccgaaaaaataatctcatatggttttcctaacacatgtgctaatacatttaaacggcctctgtgtgccattccaatgttaatatttgaagtcccttgtgtaacagactctgaaataatttcatcaagtactgggacaagtgcgtctaatccttctatagagaagcgcttttgcccaacaaatgttttatgaagaaactgttcgaactgctcaacttctgttaatctcttgaatacagaaactagtttatcggctggttttttcttaaatagttcaccagactcgattgattttgagagccagttgcgttcttcgaaatcatgtacgtgatcaaactcaaatgaaatggtacgcttatacgtatttctcaaatggttaatggcttctatgccgtttgaaatgtgttttggtgcgtcaggactaataatagatattggtatattcttgacgtcttcttctgttaaaccgtactcctttaaaggaaacagctcttgtaattccttttctttgcgaagaggattgacggaagcatttaaatggccatacgttctgatgtcttctgccagtttaacgactgatgctatcttttggatttgttcagaagtaactacgctattttcttttttcccaatttcctccttcatttcactcggtggtgcaccaagttcatcaaatatgcctcttagatcttcatcaacactagtaggatcctggacatactgatcgtagagctcgagcacatagccgaggttcggaccatgaaattcttcccaactcaacggttgtttcacatcattttgaaacattttgaacactacccccaactttgatcatcaagtgattgaacactatctcgatataacttccagaacacaatgaccaaatttatgtaataaaacgcttccaataatattctaccactgtttcggattactttctacattctttgttcaattaaagataaaaaattcacagaaaaacaaaaaatttaaatcattccgaaaaatattttgaagaaaggggcaaaaccttatgccccaatgcttttatgcagtaatttcttcagtaacggatataaaacatctggcaatgtatcgacatctggtacaaaaatgctgaacttgccatacatatcttggatcgttttcatctgtgcttcttcgatcggtgaattggataaaaacacattgattacctcaatgccttttttcctcgcctcaagaactgcttcatgtgtatcgacaatcccattttgttcgtagctgaatgcagctggctctccatcggaaaaaacaatgagaaacttttgctcttctcttcgttttaatatcatttttgtcatttggcgaatcgcatagccgtcccggttatcctcttctggttcaagagacataatggaaggacctgcatcaaataaagaatctttgaacgacacgactgtgttgaaatagttcggctgacttgtttctgatgcatcgtttgtatcttcccaaaaacccacaatttgatgtgggacttgaactgactttaaggcttcatggaatagaacaatgccttttttcgtttcatccatcttgtcaaacatgctggcagaacaatccactaataaagtgaaaacagcatcaatctccgaagaaggtgcctgttttttatagaaaagacgcggatttgactctgtaaaataacgaatgagctttttactcagacgtccagcatgaaggtccgtttttggccatgtttttttgtgttcaagtgttttttgaatcatctgttttaagcgtttctgataaggctcaatctccttggcgtgctgcttgtatacgtcgatttgttctggcgcgggaggatctggtgaaatcatgactggaaatgcatatttgttctcttttccattctcatgagcatccgccccgctttcttcgccttcagcctcttccagcgcttcaagctttgaataatcttttcggtgagtctgcttggcagagccttggacagtgccaagtgcttgatctccgtcatcgccttctcttgctgcatccttcccgagatcacttttccctccgtgctctaaatcaaattgaaggaagctttttgacggcgcttctgtttctcgatgccacacttccatatactcttgatggatgtcttcatcgccctctttttccctgtctactttgatgtcttcacttagtttaggttttcttttcaagtcatgaaacagcggttcttttgccgctttttcatagtccaattctgggaagaaaaagtacgtattcagcatatctttatcaagaagctcatcaaagccttccattaattctttgacgatgactgcgatatctccggttgaacgcgcttcatatacacgctcaagacttgattcaataaacggaatcattgggttgatccgctcatgaagcggcggaacttcttccagcggcgaatccgctgtcagcttcacatacattgcacaataaagtgcatcggttaaaatgctccgctcttggttaatcgttaattgcgtcttaaaatgacgccggtaaagttctcttcttcgtttaaataccttttttgttcctgggcggtcacgtttaatccgctcttcaatccggatatcttcaaagagcatgaacagttgtttacataggtcaggaatggacaatgtatgagcatagcgaatgatttcctgaaagacagtcagatcactataaacggttcctactgcacggaggaatacatcacttttcagtccggctgtcatgtcttcttgtttgcggtcatcccaaaaatgactgatgaaaattttcttttcaaaaggatcatagtaggactgcacaccgtattcaagctcgacatcatcactttttgctaacgttttggctaaatccgttaattccataaataaaaatgaatcgattctgctgtcattaaatttgatgaatttcaaaactcagaacctcactcgaataatgtttgggcaatatttcttaccgctgctttttcccggtcatcttctagcttttcaacaatccctcgttcaactgcacgaagcggcgggatgtattgcgcaagatcacatgtgtctaggagtgcgcgaatggatgctgcttcttcacttacctgcccgttgtgcgcctgtgtaatgaggtctgatgaaagctgcacgaattgatcgattaatcgttcatcctttaatacagattgagattgcagtacatcctttaagatgccgccgccgatatatggaacgtcaatgacaacaaaacggttttttaacgcttcatttagaggcactgtaccgacatagccttcattgatggccgcaatcacgccaaagccttcatctgctcgaacgacctcgcctgtaaatggatttgtcatcatttttctgtagtcgagtacaccgtttaaaataggcagagtttctggcttcgccatgttgatttcatcaatatataaaagatggccttttttcattgctttcgttacaggtccttcaataaattcaatagaagcaacttgaccatcattgtgaatggttttatagccaatcaagctttctgcatcaagatcaactgagcagttcacactatgcatcggctgctgaaagaaagcagataaagtttctgctagttttgttttacctgaaccggtcggcccttttaaaagaacgtttttgccgagtgctagtgcaatcatcgcatcttgtatgatagacgtgtcctgtgattcatagccgcctgttccaataagcggacggaattcttcttctagtccttttgcttttgcttcaatcattgcttgaatttcttctgggagtgattgttcgttaaacatgtatgattaattcctctcttcgatcattttcctcaccaagtatactaaaaaaacctttatgcactcaatacataaaggctagacatctgttattttaccatttcttttgtgattgctccgcaggcgatgcgtttccctgagtttccagaagggttgcttaagtaatcatctgcttctgcatgaatgataaagctccgcccattttgatcaattaattgggttggtcctccctttaacgtcacatctggtacatttacgacaacatcaatctgtccatctgccccaacttctaaattaggcatatctccagcatgatgaccctttgggttgtcaaagccatgctcccggtgtgttggattaaagtgagcccctgccgtttcaaaatctggcgcttcacatcttccagtttcgtgaatatggaagccatgaggacctggcggcaggtttttcgctttcacatgtaaatccagcccgttttctgaggattctcttacttcgatgctccctattttttgcccgttttcattgatgagtgacgtggtaactagtgcttgtttaggtgctgcaacttcaatggtttcttctgtcgtttcttttttcggcggtgcatgacaagctgttgcaacaaagaccagactcatcatgatcaaccacactgactttttcatatgattgcccccttttgatatcagtatggacaacctgatcaataggcaaacaaaaaaagccgaaaatcggcttttttagaagaaacgttttgcacctaaataggcttttttccaatatgggttgctcaagttcgagatccccacaccgctgtcacttgcatgaaggaaatctcctccgccaagatatagtcccatatgagatggacccgctttgtacgttgtgaaataaacaaaatcgccaacttgaggtgtgctcactggtgtcatcatactccagtagcctgctgtgcttaatctcgatacagatgaaaccttgttaatgagataataaacaaagccgctgcagtcaaatccagatggtgtgttgccgccccatctgtaaggaatgcctgtcagttttttgccttcttggatcatcgtcgtgatttttgcattcatcggcacatcgtttttgttattgttcactggagttgtcgagccgttggacgtagaaccattcgatccagttgagcctgaagctgcaccattaattttgagaacttgtccaattctaagcacatcgctttttaagctgttagctgtacggatggattgaacttgcactttaaattgattcgcaatcttccataaagaatctcctgattttacggtataagatgtcgctttcccgcttgaagactggttactgttagaaggcgggttgcttggttttgcaggggcttggggctgacttggttttgatgcagccgtcccttttactttcaatacttgattcggataaatcgtatcagatttgagcccattcaatgttttgatttcaccaatcgtcatattgagcgaattcgcaattttccagagagaatcccctaatttgaccttgtatgtacttgatgaagatgaactatttgagttcgttgtcttattgttcgagctggaatttgaagaggagtttgatgactggctcccgcttgtcttcgtgcttccagatatctttagcttttgtccaggacgaatcaagtcactgtttaagctgtttagactttttaagcttgcaactgacattttatgattgtttgcaatgagccataaagagtctccaagctttacagtgtagcttgatgtcgttgaagcatttgattttgttgcttttgaacctgttgaagaactggattttgtgctttttgcggcaggaattttcaagctttgtcctgcaaaaatcatcgtcgtttttagttgattaagagattgcagctccgaaatacttgtattgtactgttcggcaatcttccaaagtgagtcaccgcttttcaccttgatcgtctgtgcttctgccggtgcagcaaacacagctgagccagcgatcgctgaaactgtgaggccggttactacttttttcttcatagataaatctccgcctttcatgatttcatccaataagacttatgtactagttttaagtttcgcattaaatgattctgcttctcttgcactattttatctttatttctattatattactcgacatgtagacgttgggcaataacaaataggctaaagcagtcaactcaaaatgctaaaactaagccatatcgtttgtatcggcagtttactgtatttataaacattttttaaggaatttttaagttgacgtttagaaatttgtcaaaacaagcacgctgctagtttcatagttctattctacatgacaaatttttctgtatcaaatgactttttacttaattgcctgttttttctcctcgaatgaaaaaagcatccttccgaatgaagaatgcagcgattgattttttattttctgatttcaggttcttttacagtgagcggataaaggactccttctttcgcaaatgacattttccctgtttcctctgaaacgacgagaacaagtgcatcggtcatgccagagagtccaattgcagccctgtgtcttgtcccgagagaaggactgactttttttgaagtaagcggcagcacatttgccgcagatacgagcgtattttctttgactaaaagcgcaccatcatgaagtggatttcctgggtagaaaatgctttcgattaatgaagcacttattttcgcatgaagatttgtccctctttgaataaaatcctcaacctcatcccgcctttgaatcacaatcagtgccccatgcttttgttttgataagttctcaatggctaaagaaaattgagcaaatccgggtgtgtattcttccatatacgattgtaaataaaacgaggaagcctctgcatgcattgcattaaactcatcatgtaatgactcgagatcacaaagtagacattgctcaatctcatcaagggaatcaataatgtcacttgcatccttcataattttcatcaagtgtgttctcatgcccactttaaattgcacttcttcattcgtacgattgatcatttgaccttttccctcctttttttcgttgtcataaaataacaaatgatgcgcatgctattgttatggaggtgacttaatatgaccattcagaaagtgattcaatatgcttgcagcattttaggtgttgtcagtctttcctttatttatgcccaaatgtttaaaaaaacgaagccatctaagaaaaataatccgacagagaattgatttttttacatagcatgatataatcctctcgttatttctgttcagagaggaacttatgatgagagaaacaaatagcattcgagctaaggtgacactatttttaaccattttgattccgattttaatcactcaagcgggtctttcacttattacgtttttagacaccgtgatgtctggaaaagtgagtgcagaagaccttgcgggtgtggcgatcggttcaagtatttggacacccgtttatacagggcttgctggtatattaatggccgttacgccaattgtcgctcagctgatgggcgcagggcataaaaaagatgttcccaaggctgtctttcaggcgatttatttatcctttcttttaagtatttgtgtgattgcgattgggacaattagcatcccttacgtattagggggacttggacttgagcaatccgtagaggatattgcgcagcatttcttacgttttcttgcttttggtatcattccgctatttggttattcggtgctcaggtcatttattgatgcattagggaaaacacgagtgacgatgtttatcacgttaacagcacttccgattaactttgtgttaaactatgtatttatttttgggaattttggctttccaaagcttggcggcgcgggagctggccttgcttctgcgatgacgtattgggcaatttttatcatgagtatttgtattgtcataaaagcagaaccatttgcctcatttcgtttgtttcaaaaactgcctcgacttaatatctcccgtatggggcaaatactgaaaatcggtcttcctatcgggtttgcgatcttttttgaaacgagtatctttgcagcagttaccttattaatgggtcactttgatactgtgacgattgcaagtcaccaggctgcgatgaactttgcttctatcttatatattttaccgctcagtatctcaatggctttaacgattgtcgttgggtttgaagccggtgccaagcgttataaagatgcgcaaagctatagctatatcggaattggaacggcgatattattctccttgtttacggcagcactcattttattatttagaccagagattgctggtttatacacaactgaatcggctgttttacagatgacacagcactttttgatttatgcgatctttttccaactgtcagatgccattgctgcacctattcaaggagcgctgcgcggctataaagatgtcaactatacactcattgccgcatttgtttcatactgggtgatcggccttccttccggctatctgatcggcacctatacctcatttggagcatttggttattggattggtctgattgcaggacttgccgctggtgccattgtcctctttatccgtctcagattgatggaaaaacgactgcttcagaaatcgcccaaccactaaatacaagacaaaaaagcagctgatcgatgtcagctgcttttttatttagtcattccattggtatgtccaaaaaatttcttcatcgaaccatttttggacaacaggttctttgttttttagcttctgttcaagctctcttagcatgccttctgtttgcgttctatgtgctcttagtgcatttaatttgatatctgctacatctgtaatgtcgatcgtaatatctgcatttccaagtacttcttctctattttttgtaatagccatgcagtatgtgacaggacggtcttcttttttcttacggtaaagagcacgaatcaccgcttcccctgtcgcatcatgatcaggatgtacaccatgtccaggataaaacgtgacaatcagtgtaggtttgacttcatcaatgatggtttccatcacatcagctaaatactcgtcatcctcaaattccaaagttttatcacgcagtccaagcatacgcaagtctgtgatatccatttctttgcaggcattgattaattcctgttttcttaactcaggaagtgtttcgcgattggcatatgttgggctgcccatatttctacccatttccccaagtgtcccgcatgcatacgtgactgggatgccgcgttttctgctttgtgcaatgagacctgcaaccccaaacgattcatcatctgggtgaggcagcatcactagtacatgttcgttcatgactcgtcaccctttcttctacacctgaaatggtgtttcgctaatttgtaatgagatcgctagtttcccgtctggcaagtgccctgctaacagcaggcggccttggtcatcaaactcataatcggttaagccttctgcgtaaatccagccatcttctgttttcattccaacacggtatggaccttgtccttttattttcgcctgagaatagacaactttggcattgcggatataggcaacgaccgtcatattttgttcatttacatgagctgaataagaaccagtagtcgtttcaagatgaacgaagactggacgatttaaaaacgattcaagatgtgccgtgacatcttccgtttgaattggtttcatgagtggttccttccttcattttgaattaattcgcgcagcttttttgtatgtaagctgatcagctgcagttgatgatcatgctcaagctcactttctaatattctttctacagcgagcacatatttttgatgaaatgattttctcgccctcggatgagtccgtgcatcgcttaaatcatcacatattgctccgagtaaagaagacatatcatcgacatcaagctgacgatttttccataaagattgataagcagctgtaagctcattggctgatgacatgtaatcacctcaacagttttggtaacaacttattatgacatgatccgccttcaaaaaaaaagcaaactgctcgtaggagttaatgagaattcgctgtttttttcatgcgtaattgagaggtcgtaaacaataaaatcgccacccagatacaaagaaacgtcacaattttagctgaagttaagtgctcgtgatacacaaacaaccccaaaaacagcgtaatcgttggtgctatgtactgtaaaatgcccacttgataaagagggattctttttgcgccttcagagaataaaagaagcgggaccgcagtaaagacccctgcaaagaataagagaccaagcgatccgaaactgttaggattcattgtcaccacaggttcttttaagaagaacaataagtacacaagagctgccggggcgagaagcagcgtttcaattgtcaaaccaatggcactcgtgaagctcattcttttttttatcaatccataaaaaccgaagctaaaggcaagtaatattgcaacgacaggaaatgaaccgtactggatcgtagaaagaatcaccccagcggcggcaattaaaatcgcaatggtttgtattttattgagccgctctttcaagaaaatgatccctagtaaaacagagacaagcggattaatataataccctaaactagcttctagcataagatgatggttgactgcccaaatgtacacataccagttaaccgatattaatatagcagataatagtaatgaaaaaagtgctttaccatcgagcatgagacccttcacggtctgcatggctggccgaacttgttttaaatacaaaagaataccgcacataaaaacaaatgaccataaaattctgtgcgctaaaatttcgcctgacgaaatatgttccatcagtttccaatataatgggaataatccccataatgtaaaagatgctgccgtgtagagaacaccttttgattgctgttgttcgttcaatctaaccattcctttctaaacctatcgtatattatagcacgcactcaagtgaatgggcatatactaattcagggcaattagaaaggatgattttcatgtttgactggaaccgattattcccttttcaaaagcaattttcaaaagaagccttaaagaattcagaccctaaagacgtcgagcagtacgtcaatcaagtgatggaaagtgtattcggctccaattatcctgctcagttcccttttcaggacccactctctcaacatcaaaaaacgagagaaacagatgtcaaaaaagaaaaagaacccgaagtagaagtgtttgaaacaactgatcacgtgtttgttaagattgagcttgctcggccgaacacagaaaaagtaaaaatcaaacataccgccaacctgctatttattgatcattttcctgaggaaggcacgcagaagaaagtcgtcctccctgctgctgtcaaaagaaaaggaacgaaggcttcgtatcaggacggtattttggagattatgtttttaaagcatgatgatccggggatttctgaaatcgatattccattataaaaagcctgctttgatatagaagcaggcttactcttttttcttaatagtatggtggatatcctccgccataaggtggtggaacaggcggtggtggtggcgggtaatatggacggggataattaaaaatcgcacttcctaaaaatccgccaagcagtccgccgactaaaggagcgccaaaaccaaaaaacaaagggactctggattcatatggcggaatgccaggggcgccgcctcggaaatacggagtatgagggtacatgcatttctcctcctttgtcatgtgcctaagatcagcatattcatcaggagtcaaaacgtttgggcaaacctgaaactaggcttgctcctttttttcatgagattctgtatattcccctgcccacctagatacctcatgaaacacatcatgtagcgcatttcctttttcagttaaacaataaatgactttaacaggcgtctcaggaagtacagttcgctttataatcccttcttgctcaagttcttttaaacgctctgcgagcattttctgactgatagatgggataatgtccgtcatgtctttaaatcgctttggaccatcaagcaatacatgaataatgagaccattccaccttttgcctagcagtaaaaaagcttgctgaatgtgtggacataattgaaattccataaatttcagcctttcttttcatgattgtttgacaaactaacggtatacaatttaaaatatctctagttacaataagtaagtttctcacttttttagttattgtaccatactatttgcaaaaacgggaggaaatatccatatggcgactgatcaaaaaacgattgacattttaaaacaaagagcttcagtaaaagagtatgatacgactcatgaaatgacaaaagaagagctaacagagctacttgatatcacaacaaaagcaccatctgcgtggaaccttcagcattggcattttactgttttccacagtgctgaatccaaagcaaagttacttccaatcgcttataaccaaaagcaaatctcacaagcatcggctgttattgctgtactaggtgatcttgaagccaatcaaaatggagaaaaaatctatggtgagctggcagaacaagggttcattactgaagacatcaaagaaacattgatgactcaaatcaatggcgcataccaaagcgagcagtatgcacgtgaagctgcgtattcaaatgcttcattagctgctatgcaattaatgattgctgcaaaagcaatgggctatgatacatgtgcaatgggtggtttcagtaaagaagcctttatcaaagaattcaatgtaagcggccgttatgagccagttatgctgatttcagttggtaaagcagcgaaagaagctcataaaagcaaccgcttcgacatcgaagaagtatctgattttctttaaaaaatggcaaggcctcagctttcatgctgaggctttttttatttggtttaaatattatttctacatattttcttttcacttccccccttttcatctacactttttctcttttttaagaatgaaagcgttatattaggatgatattctgcaaaatgattgttttttctgaaaatggtcttgtgatctaatctgacaactgctattattatgaaattacaaaaaattcaggagggaatcatgaataaaaaattgatactggcactacttatagcgattccattcatcggacagctcgcactgctgccctttgcgaatcgtattcatccatttgtgataggcctgccttttttccacttctggctcttactatggattgttctcacaccagtctgtacatttatcatttatcggatgcaacattcaaatggaggaactgactaatgcaaggaaatttgacagctttattgattacagcaagtatcattttcatcgtcgtggtcattggatttgccgctggccgtgataaatcatccagacagtcagtagaggaatggtctgttggcgggaggaaatttggcgggctgctcgtttggttccttgttggtgcagatttatacacagcttatacctttttaggactcactagtacagcctatacagctggaagtgtcgcttttttcgctatcccctattcagttctagcgtattttattgcttatttcttcttaccaaagctatggacggttgcgaaaaatcacaatctcacaacgctcgctgattatgcacgtgagcgctttgacagcaaactgttatccagtctcattgcgattattggagtacttatgctcattccgtatatttgtcttcaactgagcgggattcaagatacgttaactgtcgctggaactagttatattaatgtgaatgcagttgttattatttcatttattttagttgcactttatacatttttcagcgggattaaaggtcctacctatacagccattattaaggatattctcgtttgggtcatcatgctgtttatggtggtttcactgccaatcattcattttaacggctggaccccgatgatgaatacgttagcgaaggaagcgccacagcttctgacaattcctgacgggggtcctaaaggcattttatggttcattaccgcttcaggcgtttctgcccttgctttgtttatgtgggcacatgcggcaacaggggttttcacagccaaaagtgcagatgctatccgtaaaaacagcatgtttttgcctctttataacattgtattgattttggtcatcttccttggatttattgcctttttagtcttaccagaagatacgaatccaagatttgcacttcttcatttaattcaaacgtcatatggcggcgtgatgcaaggtcttgcttattcaacgattgcactggcttccctcattccatgctcaatcatggccattggtgcatcgaatttatttgccaataatttatatcgtgacttaattcatccgaatgtatcacctaaacggttgaccatcatcactcgttcaatggtgtttatcgttatcggactggctctattattcggaatgctcttcccaacagcacttgtaacgcttcagcttattggtgtttcaggaatggttcaaatcttcccagccattgcgatcagcttgttctggaaaaaacaatcgagagaagcaacgattgcggggttagttgttggcattatcgtcacctttacagccaatatctcacaagtcacgttcggtctttatgaagggtttcttggtttactagcaaacgttgtagtcatcctgatgttgaatccattcttccagaagaaggtctcatctaattctgtcatgaatgatctatttgaaaaagatcaagaaaaaacagaagcaattgtaaacaacgcgtaagtataaaaagagcagtccccctaagaggactgctctttctttatttcatttcttttttcaagacttcaatcgcttttttcatttgagtatcattattctttagcttatcttggatctttgtcatcagtactgtcgttgtatctcccgtcagaattccgtctgctttcaaatcgttgtctgtttggaagcttttgacgatcgtctggaaggcttgatcgtactcaccattggcttttgctttgtagtcaagcgcttggaacattttttgagccgctttgacttcatctccattgtcattcagctgatacgtttttttcgggcttaagtatggcagctttgcataacttgggagtgatgctttgacctgtggttcaattccttttttgtgaatccatgaaccatccggcgtcagccacttggcaatggttaacttgacactagaaccatcattatagctttgcgcattttgaacagttcctttaccaaatgtcttttcaccaataattttgatacctgaagattggtgtagagccgccgccatgatttctgcagcgctggctgaaccgccatttacaaggacaactgccggctgatgaactttacgttctttttcagccttgtactcttctttcttccctttttcttcaacttgcatgatgactttccctttatcgataaagtcattactcatttcaatcgcttctgtcatgataccgcctggattatctctcaggtcgatgacaaacccttttgccccttttttctcgaggtcatcaatggctttatctaactctttcgatgttgtttcagcaaaggacgtaatttggatttctcctattttgtcttttgtgagttttgcatacactgtttcaactggaatggtgtctcttgtgatggtcacatcaacatttcccactccttggcggttaaggtgaagcttgacatccgttccttttttccctctgattagagagactgcttgattgaccgacatgccttttgtgctttttccatccacctttaaaatacgatcatgaggtttcaacccggctttttcagcaggagagcctttaatcggtgcgacaattaaaatttgtccatccttctcttctacttgtgcaccaattccttcaaatgatgaagaaatggtgttgttaaatccttcggcttcctcctggtccatatatgtagagtatggatcatcaagtgatgcgatcattccttgtatcgcaccatctactagtttttgatcatccgttttttcgtaatactcatcttttaccttcgtatacgcagccatgagtttactaaacttctcatctcctgagacattgacggccccttgttttgtgatcacaaatgtaatcgctgaggacagtgccgctgtcaccagaatagcgatgacgatcttaaattgttttctcaaaaaaacaccacctttatctcctttcattattatcaaggacgatgcatcatccgtcaaccaaaggatcgaagttctctttgaaaagataagccatttgaccttacattgcataatctttaaagaggaacttgataaggaaagaagggattttatgagtgattatgtagaaatgcttgcctattttggcgtatctagtgcccatcctggtggaattgagttaacaaaaacgatgcttgagcatataaaattgacgccggatgcacgcatactggatgcgggatgcgggactggacaaacggcagcatatttaggcaatatcggttatcaggtggaggcgattgatacacaccctttgatgattgaaaaggccaatctgcgatttgagcgagaagaactgccgatccgcgcattacaagcatcgatcgaacagctgccatttccagatgaagcgttctctctgctgatcagtgaatctgttttgagctttaccaaccttccagcggcacttgctgagatcaaacgcgtgcttgcccatggaagtcaaatgattgcaaatgaagcagtattaaaagaaccccttacacagaaggagcttgccgacgttcgagatttttacgggtttcacgcactcttttcacttgaagaatggaaggagcagttaaaagcagcaggatttcatgacgttcgcattctctcatttgatgaacacatggtacaagaggagccgacagaaatggaattatctgaatatatcccgccttctctttacgaaacgatgcaaacacactacgatctcattcaagcgcaccgaaagcagctaagccacattctatttgaatgtacggtataaaatgagcgaatctcctatatgttttgtccaaactctatgaggtctctcgcataggataagagtgaaaagagtttgtcataaggaggaaaaatatggagcgctatcaaaagctttgtcagcagcatatggggaaagtcgctagaatcacagatcgtaatggcagagtacatgtcggacgcattgagcgggtgacaaaccgcaaagtgtatattcgtccagtcggcggttctcgcggcggctttggctttggttattacggagggtattacggctggggtgccgcttatggcatcgggcttggtttcattacaggtttcgcattagcaggattgttctttttttaaaagaagaataaagaaggccccccgaatagctgggaggccttttactttgattaaattttcttcactttgttcatgtactcttcaaatgttaaatcgtgaacatgcatcgcttttgccgcttcttttccaacatagcgcagatgccacggctcatattcatatttcgtaatgtcttcttttccttttggataacgaatgataaaaccatatttataggcgtttttagccacccatttgccatcaggtgtttcaccaaacttttcagagatgtcaaagccggcactttttgaggaaatgtccattgcaagacctgtttgatgttcactttcgcctggtaaagcgactgcttcttgcgctttgtctttgccttttaacttgacttcactatcaaaaatgaccttttgacggtcataggagcgatagccagatacggcagccagctcaaagtttttctttttcgcatctttgaataatgtttcaagtgcttccgctgcttctttacgaatatatcgtttttcaatatcctctgaaaaagagaattctacttttggtacaacgagatcagaaggtttataggttcctggtaatgcgtattctttgttgacaagtgctagcacgtttgcaggattttgaatggttttcagcccgcttaccactttgatgtcattgaaatattcactctttaacgtcagctcttgatccgatgaacctgctgtattgtttgagttttgctgggtagatgaatttgctgcgctcttttgttcgtttgttttgttcgattcagatgtaccgctcttttgatccagcaactggcagcccgatagtgcggctgtcaaaccaagaatcgatgcgattgagagtattttatagcttttcttcatgacataccttccttttgctcttctaaaaaaataaagatgcgctacatcgtagcacaccctttatactattataaaacggagtctagtgcaattaagatcatttcgtcaaatgtcgtttgacgctcttcagccgttgtttcttctcctgtgagaacatgatcactcactgtcagaatggataacgctttacgatcaaattttgctgcaagcgaatatagagctgttgtctccatttcaattgctagaattccgtattgagccatgagctcaagtggtttttcattgtaaaattggtctgctgtaaatacatttccgacacgtacagcaacattttttgcttctgctgtgtcataggctttcttaagcagtccaaaatcagcgcaaggtgcgtaatcaatcggtccaaacgccacacgattcatttgtgaatctgttgaagatgtttgagctaaaatgacatcacgtacgttgacatcccttttaatagccccacaagatccgacgcggattaagttttgaacatcatagctttgaatgagttcattcacataaatcgaaatagaaggtacgcccattccggtaccttgtacagaaacgcgctttcctttgtaggttcccgtataaccatacattccgcgcacttcgttatagcattcgacatcttctaaatatgtatctgcaatatatttcgcacgaagcggatcgcctggcagcaataccgtttctgcaatttgtcctttttctgctccaatatgtacactcatttttttagcctccacttacgtttactatgtgatttgtcctatttagtataaacgattgagtccaaaaaagaaaataccagctgaagctcaagctggcatcgtctatcatctatttaactcattgtcatcagccgcttactgcgtttccatcctgccggaaaaagctgataatagcactttccttttttcttatcatcaatcacaacaatatcgcctgttgtcataaagcgtgcattgtaatcactagggactgtatcatgtacattaaatgtcgagaatgctttttccagaacatccaggtgtgttctgccgccaatctttgttcggtacacaggttgatgcccgcttgcagcgccatattcaggtgtctgataaatggttaagtgaaatgctgaaggttttttttgaaaaaatctcaacgtcaattgcattcaaatcccctccccttttatataaaattggctgggatctgtcaatttccttcttctatttttgtcgaatgacagacaacttttcgtcaatctttttacaaatgagaaataaagcaagtcctatcgcaaaaccgcccgcaacatctgtcaaaaaatgaacgccgatatacattctgctgattccaatcataagaacacagacccctgtgatcaagtagacgattttttgtctttttttcagccatggaatcatttcaacgagtagataagctataaacggatagattgtggctgcattcatggaatgtccgctcggaaagctgtaatacgtttcattgacaagatgatcaaaggccggacgctctctagcaaacagcccctttagttcatgattgatggttttttctgtgaggtataatagaaaaagcatcatgatagagtaatagcgcttatacatgaataaagcgacactaaaaatgagcatgatgggcacgagtagcgcactaatgccaaaatccgtcaaagtcagcatgacatcatttaaaaaagggagtctgatgctctcaaaccataagatgatctggttgtccaatgcttgagccgctctagataccatgagcgcagcaatggcgccaaataaaatcaaaagaaataggatatacacgccaaagattctcctccctctctttagaatctcttcaaagtatagtgcctaccacgcctcttcttcaactatcattgtttttttcagcatatattcaaacgtaatgtcagccagctcaaatgtttccagctcagcaggtatgtaccctcttttgatcagctccatgtagaagaattccgcaatttcctctgtatcgatcaccaaatctgcttctttcattccattccgcctccttttttatgatgtatgaacgacgcctgttttttattacagtttgtcataatggctcattccatacatataaatgcagtaaacaaaaagaaaaggggtttgaggcaatgaaatggttaagcatattagatggagaaacgtttgatcagatgatgggccgtatcttgaggggatggttttatgtgattgtttttttctgtgtaccttattttttattcgtgttaggacaagtctttctttaaccaaaatgctcgtgtaaactttccaatataaaatccatcatatctttgtattctggatcttcgaaaaattcgtagagaattttatagtcattataaatatcaagaagctcatccactatagatacagcgagaaattctagtgatgcttcgctttcttgtttctcttctaattgtaatagagccgtttgcaccatatcttcttccatttctttagaggtttcacccacgtaatgcacaaaaagaagctgatgaacaaactggtccatttcatatttcctcaggacaagcgttaagtcttcctcttctgtttccagccactctccatcctttagccttgtgagttcgtaaatgacatcttcccagccgtcatcaaggtatcgccatatttcagtccgatgaccaataattttaaatagctcttttccgtaatcttttacatatacaacatcgccaatgaggaactcatattcaatgtccagcttttctgtatccacaatcaccccgtcgtactcatcgtaaagctggagtgatgtttcaaaataaagcacctcattatgattgacctcatacaaatagtgctggtcaatttgatggacttttgtaatcgttccgactgtgccgtacatgacaacgacgacaatatcccctacttgatattttggtgctttcgccttcattctgtctcccccttgcccgacttttggtcttaacgtatcgtatgccggcgcaaggaattctgcatgggcaaccacaccatgcaaaacgccattttatttctcatcaaaaaaccgcttctcccatctggaaaaagcggttgtgtgttatttttttttgacttctacatcatattgctcaaacgcttcgtcaaatgttgtcattgagcttaaataatcgccgtttaattctaaataggcacacagctcatgataatcagtggacgctttcgggaagctgtgatcctcataagcagcatttgcaaaatggctgatttcatctttcggttttggatgtctgtacttcattaaataatggtaaaacgacttcacctgtttttccctccgcgacactctattttgttgttatattatacagcaatttgatgacttgtataggcggaggtacaacttatgatgaaaagtcaaagtaatttcgctttaatagccgctccatgctcattaattcttcgtatgaaattttttctggaagttttgtctgatccactaaaattaattgatcttctatctctttgaccgtctcatccttttgatatgtcataccgcagtgcgtgcaggaaatggacggtgtttcgatgatttcaatggattgtgtgccagtgatcagttcccaatagactgttgtctgttctgcgtttgctttattttcctcacaccagtcacatgtcagcacggttatttctcctcctttacagtttgatcttttttgagctgcgcttgatattttttctcttttaattcatctcgtttttcacgtttgtttttgagtgtgtcatgctcaggatttgtctcatatgcttctcttcgtttcatccggcttaaattctctggcgtaaacgatttcgcttcatcctgaaatagtgcggtaataccaattgccggatcttgtttctcttcataaatttcattaaaatacgcatctgcctggcctgcaacgtaatgctccggttcagggtaagaggtgatgacaccttcaaagttacgaagaacgactttgtcagggctttgcgataataaataatttggctgcaaggcgatctttcctccgcctcctggtgcatccacaacaaagcttggcacggcatagccgcttgtatgccctcttaaaccttctatgatttcaagaccttttgatactggtgttctaaagtggccaatgccctcagacaaatcacactgataaatataataaggtctgacccgtatcatcacgagatcgtgcatcagcttcttcataatcggcacactatcgttaatacctgcgaggatgacggcctgattacctacaggcacgccggcatttacaagacgttcgcacgcttcttttgcttctttcgtaatttcaatgcttgtattgaaatgggtattcagccaaaccgggtgatattttttcaaaatctcgcacagctcatctgtaatgcgctgcggaaagacgaccggcgcgcgggtccctatgcgaatgatctcaacatgcggaatgtctcgtaagtttttcaaaatgtattcaagcacttgatcgttgattaagagtccatctccgccggaaattaacacatcccgcacctcaggtgtttctctaatatatccaatggcagcatctaactgcttttttggcacgcccataccgatctgtccggaaaaacgtcttctcgtacaatagcggcagtacatggagcactgatttgttacaagaaagagcacacgatctgggtaacgatgcgttaaccctgggacaggtgagtcttcatcttcatgcaaagggtcttccagatcatattttgttttatgaagttcctcagctattggcacagattgcatacgtactggacatcttggatcgtctggattcatcaatgaggcatagtagggtgtaatgttgagtggaatggttttggtggagatcttcaccccttctctttcctcttctgttaagtttacgactttctctaaatcttcaagcgttttcacggtatgcgtcagctgccaaatccagtcgttccatttttcttcaggtacatctttccaaagctcaatgtccttccaatgacgcgccggttcatatagtttttgattcatatccattccccctatcagcattcaccttatactatgcaagttatgtgccaacatgggaaaatgcccctattctttataaaaggagctttacccgtgatattcaatggatggtggtgcctatatttcggcatctgcaaatttcttcagtttatattgcagcgtttgtcgagggatttttaaagcggcggcggttttttgaatattgccatgatgcttgtttaaagcttcttgaataagtgtttgttcaaatgaagaaacctgactttttaaggacgcatcggttgtttcttcctcaagcttctgcgtacgtaaatgagcaggaaggtatgaaggtgtgatgtcttccgcttcctttggcatcatcaatacggcatgctcaatggtatgttttaattctcgaacgttccctggccagtggtgagccataaacatttgctttgtttcttcagaaaggcgtttgacgttttttgaaaactgctgatgataggtttgaatgaaatggcgggaaagcagcgggatgtcttgttttctctcacgaagcggtgggatatgaaaagatgacacatgcagtctataaaataagtcttctcttaaaatttgctttttcaccgcttcaaatgggtccatattgagtgcagtaatgagtctgacatctacttgaattgcttttgcatccccaatgcggcgcaccacaccatcctctaacacacgtaataatttcgtctgcagcgtgagcggcatcgcttgcagttcatcaagaaaaagcgtgcctccatcagccaattcaaagagccccttacgatcaattgcgcctgtatagctcccttttacagatccgaacaataggctctcaagtagcgattctgggagtgctgcacagttttgtggaatgaacacttggttttttcggtcagattcatgaacaatggcttgaacgagcacttctttccctgtccctgtttccccgtagacaacaactgatgacggataagcagcagctttttttgccttttcaagcatttcttttaagagcggatcatttgttaaaaatgaagaaaaatcatgcatttgttctgccccagccgcatcatgtattcgttttttttgatctaaacgatttgaaagggctgacagcttcgatacatcttttgcgacttcgaccgcacctattaactggctgtcttcaataataggcaatgtcgtgttgacggtctcaattctttcgccgtttttattcaaataggtttgcagcgaatgataaatgggcttccctgttctcaaaacatgcataagcgtacttgttttttctgttaaagagggatacacatcaaggatgtacttgccaatcacttcttctttttgtaaacagtcaaacttagcggcattatgattgtaaaagatcgtcattccttgatcatctacaacatggatcgcttcatcaatggcttctaaaattaattcaaaccaatccgctctttcgacaaccttccccattctttccccctcactttcagtgccggaaaaccggcatccattgccgggttttcagcggcttaatcatctttatcacacgttctcctgtcctttcatgtttcgctttttccttgcaacttcctgctttttttagcaatagcatcaaaaaagcactcctcttatgaggagtgctttcgccctgatgtttgataaagagacatatcgaattcttgcagcgattccatatacagcggcacgatcggcttcccttcttgaaataacgtaaattgggaagggtataaattaatgggctgatgataaaaagcaaatcgctttacaacctcaggatcaatacggcaaaaggtatgatgcatcagtaaatacacatcttgtttccatttaaagagccgcctgtttggcggatgaaatgctggagacacttgaatcattcctccatctttaaacatctgaagccgttcatttgaaatcgtatagatctccttagggtgaaactgaaaatattgcacgtcacgctttgaagcaaatagcctttttttctgatcttcaatataatagaacgttttcccatgatctgccgtgacaactgtataattggggactgtcagcatatcttttatctcatatttcatcgcacataacgacggaacccgaatcgcacgcctgtttttttcattcacccagcacctttcaattctatgaagatttccgtttgcgatttggtagtaatccccttccttttcaatcaccgttccgtcaatgagatcatacggcatactcgaaaacaaatgatgaaaggaatgaggcgttttatacgttgtatcaagtacatctcttaatggaaagaacgcagcaaattgattcaatctcatccaaaaaacggaatctgcatgatgccagtgttttggctcatcagcccaatattgtccatatttttcatgaattagcggaagcaaacatcttctgtgcatgaccgaacaatggtccacttgaaaggacgcatgctccaatatttggtccgcttcacgcacaaaactcatcgtctcgactaattgcttattcacatgcacgacccgctgcgaggaatacacaatatctatatgaggcttcgactgaaaaacatccaccattttctgcaaacgatcttgatgatacacgctatcatctgttaaataacaaatgagctcacctgttatacgagctaacgcttcattaataagcgtcgcataccgtacggttaacagccgttttgcaggatgaaccgagcgtgaatacagatgaatgcgttcatcatctaaataaggctggatcttttggatggtgccttgttctgagccatcatccataatgagaagctcccaattggaatacgtttgttccaccatactttttagcacacgatcaatgaaatcaggtttattgtagcttgttaaaatcaccgatactttcatgatcattatcctttttaattagattaaaaagccccccagctgacgatgctcacgtaaggaacattcactcttagctgattagtcgcgtttttaaagaccgctactgtatcaaagagctgcacaacaactacgttttgaaggacatctccattgaccaaatgaacacgtggcagcggaatcccaagctccagccacggacgaagtaattctttgatgtctgacacactctcttcctcactttcttctaatagacgaagaagaagtaaaatcaagatgacttcaagtactccttctgcttctagtaattcttcgttccaaccatttaataattgttcaaattccattcataatccctctctcttcgcatttaatctttactagagtatgagatttacttcatttagcctcaacatttgaaaacattttttaaaatgtgtgaagtgattaaatgataaaaagggcaaggaatcagcgttctgcttataccaaaaaaaatgaacggcatatacataggggtgagtttgaattgatgaagaaaggatggggaaaaaatgagcgacaagcgtgccgaattaaaaaaagaactattgaaagtgtttttcaaaccacttactcgtgcattaacagttaatcttgaagaaggaggggttcaaatggaagaaaaattgaatgatttactaagtgaagtggcagccgaggcatcaccttcagattctgctacaacactcgatgtatcgcagccagcaagatggatttttgcaagacttacaccaggaaccgtcattagcattgtcactgattcaggagacttaatcgggccagttcaattcgtatcattcgatgcgtcaacaggtgttgtctttgttacacaagaaagctcagtcacaccaacaggctctgcaacgactttactagatgtagataaagttgaaagtgttacgttcacgtcttaatgtgagagggccatcatgaagcttctttatatcagctctggctacggcggaatctatcacatgtttgatcaatgggtagaaaagagcttcattgattctcccttttcatgtgtaaaaattgaccgagaatctctacccgctcacatgcacaaaatccggacattttctccggattttgttttgatgatgatcggtgatcaagttccgagtgaagtgcttcatcaattcaaacaagaaaagattccgatcgttttatggatgacagaagatcctttttatacagatgtgtcagctgcttgcacgcgtgatgcgcggctcatattaacgattgatgaaggagctttgccattttacaaggaattgggcataggtcacgcccactactttcccattccggcaaatacacgtatttttcaaagaaacgaatcggctgaaaagatgtgcatctacgacatcgcactcattggctacccttaccccaaccgtatgaaagccattgatacacttttacaacagaaaaaatggcggattttcgttgcaggtaaggaatggcatcgtcatttaaataagtcacgaagacaatatcgagatctcacattaatgaccaattggctaagcccccagcaaatgtcggacatctatcaacaatcagcgattgttcttaatccgcatagaccggctcactttgcctataacaaaaacaaagccatgattcaaaatgtaagcctgaacaacagagcgtttgatatcgctgcagctggaagctttcaattgacggatctacaaccgcctcaagctttttcaagcttcgctttttataaagatgaggacgatttgctgaagcaggttgaatattatggatcaaatgccgagaaaagaaaagcaatcgcccgaaacaattacgaacaagtcgtttcctggaatacatttgagacatttccacacagactttatgagatcgtaaaaagcgccctatgaatgggcgcttttctcgttaaaatttttcttatgcctaatcctccgcatttctgcgagccaataaaactttctccgctttctcaagatcttcttcctgtttcaccacaagtgatttttggggatccatgatatacgctccaacagatccttctaaaaaggaatgaatacattcttttgcatatggaacatgaaaagcatacactgctccatttaaacgaccatacgtatatggctgctctttctttggcatgaaaaagtaatgattgtccttatataaagtggcttcattattctcatgcaatgtccatgtctcatttgggttttctagcgcctctgtaaaagatgccatgcagtcataacttccttctactagaagctgcaagcatttctctatatcttccagctgtcttaaaggagacgatggatgcaaatagagaacaatatcaaaggtcttcccctcacgctctaaataagcaagcgcatgcttcactgctatgagtgacggtgtttgttctgttacatgactgtctggcagttcaatcacacgggctccgtagtgtgaagaaatgatttgcgtattgacatcctctgtagagacgatgatttcgtctaactcaatcatttgcagtaacggttgaatggtccaatagatgagcggccgctccgccaatatgcggatatgttcatcatgctgatcgcgcctgcttctaaaagctggtatcaaggctaaaatacgatttcccctatacatatattccccttctcccctcgcgcgcagctctcttcactttctcctgagctgatcgcagtaatgaagtgttcaggtctctcgtttttctacttattctcttatctctccatattctattaagacgtcaagcagatggttataatgtgttcacctaatttatatagaaagtggttcttttcctcaaacggataccactctttcacatatgatgcaaagtagagaaatgagagttgggggattagatatgtccaaaaagatagaaaagaatttgaaggctttttttcgtgacaaaacgatattagtcacaggcggtacaggttcaatcggccgtcaaattgtgaaaaaattaacagcatgctttccaaagaagattatcgtctttagcaaagatgacagcaaacaatacatgatgaaaaatgagtatgcagatcacccagaagttgtcttcgctttaggggatgtgcgagatgcaagccgcgtgagacagctcgtcaaaggcgttgatatcatttttcatgcagccgccttaaaacaagtacctacttgtgaagacaatccgtttgaagccgtacaaacaaatattatcggcgggcagcacgtcattgaggctgcgattgaacatgaagtcagtcatgttgtcaacatctccactgacaaagctgtttctccgacaaatgccatgggtgcaacaaaattaatttcagaaaaactatttttccaagcaaacgaaagtattccaaaccaaaaaacaatgttttgctctgtgcgttttggcaatgtgcttggatcaagaggttccgtcattcccatcatgctccagcagttgttaaatgaaaaacctttgaccgtaactgatcctcatatgacacgtttttttatgtccatcgaagaggctgtctccctcacacttcaagcagccatcatgatgaaaggcggcgaaacgttcattctcaagatggagtcattacagcttgctgatctcttaaaagcgtttcatgaatatgctgctcaaatcaatgtcgcatctccggaaattctcgttgtcgggaaaagacctggagaaaagcttcacgaagagcttacatttccgcacgaagcagatacactatttgagcatgaacaattttatgccattttaccaagaccaaaacggcatcctgcctttcaaaaagtcgacttaaccaattacacatctaatgaagcgcctctcattacaaaagaaaagctatttcacatcattgaacaattacatcacacgcatcataaaaaataaaaaatcgtcacacggaagcagatgctttccatgtgacgatttttcaatagatcaatcaaagagatgtttcaaatccccatagccttctttttcaagatcatcttttggaataaacttcaaagcggctgagttaatacaataccgaagtccatttggtcctggtccatcaggaaagacatgacctagatgagaatcagctgtcttgctgcgcacctctgtccgcaccatcccatggcttttatccaccttctccgctacttcttcatcttcaagcggctttgtgaaactcggccagccgcaatgggcatcaaacttatctaaagaagaaaaaagcggcttgcctgagatgatatctaaataaataccttcttctttatgatcccaaaattcattttgaaatggcggctcagtgccattattttgtgtgacttcgtactgcattcggtttaattcttttaatcgtttttctttatcgtttgtcatgatttatcactccaatgggactcaataaaacccgctctgccagaaccgacatgatatcgttcatagtgcattttgttctttttataatagtgctgatgatactcctctgcgggataaaaaggagcagcatctaatatttctgtcacaattggcttttggaaagtaccgctttcgttcagcttctctttcgatgcctctgcaagctttctttgctcgtcatgatgaacataaatacctgtgcggtaggactctcctctatcaccaaactgcccgccatcatctgttgggtcaatttgctgccaatacagttctaatagcttttcatacgggaaaacgtctggatcaaacgtaatttgaaccgcttctctatgtccagttgtattagtacatacttcttcataggtcggattcactgtatgtccgccagtataccctgattcaactttgataatgcccggctgttcatcaaaaggtttaaccatacaccagaaacagcctcctgcaaatgtggctaattcttgtttttcagacatattagtgcccccttcatttaaaaaatggtatcatcatattataacatgatgaaaaataatgaaaatgatacgacttgtctatctaaatgatcaaaaagcattttgtcgtattttaaaatataatgggggtttaatgattggaacaaagaaaaaaaatgatgtatgaaatggatactttactgagaaccgtatttaagcagatccgttatgagattaacagcctgctcgaaaacgaattatctcggaatgaatttctcattttaaatctgcttcgtgagcaaggtgcaaaaaaagtaacggaatttgcgtccattctaggggtgtcagcaagccatatcacagctgtgaccgacacactcgtagaaaagggctggatcacccgtatccgttctaaagaggatcgccgcatcatcaaaatccacttaaccgataagggtaaggaaattactgagcattttgagaaaaagaaaacagaatactttatggagcgatttgagtcattcgatgacgaagaactgaaaacaatgatcaaattatttaaaaagctggataaaagtcaaaaggattaagcatagaatttagcgcactggacatgctacagataaaaagaggtggaataaaccatgacaagcccttatctttgtccaaactgtaaaacgaacagaacgcgctttaatctgattgagcagctttcagaacctgtgaaacttgaccctgcgaccggagcagttgtcgaaagatacgatggagagcagctttctccttttcacatgagctatcaaggtccacaaataaaagttcagtgcggtgtttgtggtctcattgaggaagaaaaaacgttcattaagctagctgaatatcatcaatattcttctccttcttaacatgcgggcctgacggaaaacgtcaggcttttttctatgcttcgtttgcctatacagatcacctttttcatgcatacgctacaaaaaacaccatcgcatgagaaagtagggattgatacatgcagcagctcttttatcatgactatctataccgttcactcgctgcgggtttcgagcatcctcaaagcagcgtttcatccaaagcctttattcggctctttcacgctgccccagatcttagtgagcttgctgtttatgtgaaccggaatgaggtcttgaaaaaaatgccttacagccagttaacagcctatatggagtgggatgagggaatgtatgagatagaagtgttcaagctagctacaaaacaaagagttcttcattctcgtatgataattaaacgtgacgagatttacaccctatgtatcacgggtgcacatgcaggttttgcgctgctgacagagcggcaagaccctctgattcaacacgaggacctgtcagctcttacctttgtccacctttctccagaccttccttccattgatatatatgaacgtgatcaaggggtgttagcaaaggagcttcactatgtaaacagcactcacattcatcatttctccccgaataaatatcattttgaattgaaagccgccggcactcaaagcatactgcttgatatcccaaaagttcatctgcaagcaaatcgcgcatacctcattctgcttcatggatttgctaatggagagccagagcttatggcgaaggtggtcttgtctcagcaaagataaaaaagagccttttccatagaggaaaggctctttacgagacatcttcagctttttcttgcttttgaaaatcaaaagcaagaatcatgatacctagaaataatgcacaataggcaatatttaagtaaaactgatcgatattttctgctcttaaatcagtggcagctgtaatgccaaagtatgcagcaaataaaaacgacagtaaactaaaatattgatagactcgcttcatgatttcactcctgacttactttctattgctttggatgataatatgagaactcaatttcatcgttctctagatcaattttgtttgctttcacatacatatcattcgtcagtggcatttctgaaaggcgcacttcaaccgttttttgatccggtttcacatgaacaaattctggcagttcatagaactgacccatgtagcttagtacaaaactaatcggaatgctcaattgtccaattgaaaggccatccactttcaaaagcacatcaccattatcttcgacagttggcgtaaatgagacgttagcatcaatcgtcgaagagaaagcctttatggcgcctgttactttcacatcttgatcgatcgccacatgaaagtctggcatatcacttgacccttgatttttcaagtaatcattgataaagctggtgagtgattcctttgagctagatatattaaaagaatactcacttttcaattctttagttgaagcggattgaccgcctggcagcaacatcaaaataccgcaggcaactacaatcaatagattgattgcaagtaaaataaaaaataagcttttccactttttcatacgttcaccctattccttcggcagtccttcttttttcactttggagaataaacgatttgccataagagagtatcccttttggtttgggtggaaatcatcatctgccagtaatttttcatcagaatcttcctcaaataaatctgctacattgaccatatcagcattgccgtcttttttcagttcttttttggcgacggcattccagtctttgacgacttcatcaatgtctttcagctcagtgagactgaatttaaaaggattatacatgcttacatacatgatcttcgcgtggtcattatgttctctcagttgagcaagaatggttttaaagcgctcctcaaaaggaccctgctctttttgaaaaggagcaaacgtcaaattgagcacattttgacggacgacatgcattaagtcattgccgccgatcgtaaagaaaatatagtcagcatctttcagaccgtcttgcacctttttttcttttaatctttttaataaatctaccgttctactgcctttaatggcatagttttttaatgtgacagattgcacgccgtccaccgcttctaacttgtcacgggttatgcctgcatatccttttttttgttgatctccgattccttctgttaaggaatctccaaccgctgcgatcgtaatatgttcttttacgttttgtgtgtcttctagtttatcctttatgccagcctcttgtgcggaacatgcagaaagaacaaaagctagagacatcacaatcaaaatcaaacgagccttcaaacgatgatgtccctcctttttctgattaaaaaagtgtatcatgtttttgctcatttgaacatctttatgctagcttcggatcagcgttttgatgtccttgatgatgtcatcatatggcgtgttttgtacaccatcataatttttcatcacttttccttcttgatcaactaggaaaaacaatgactgatggatcacttggtcttcatcttcgggtttcttcacaatggttttaaagcttttcattgcgaatttttcgatcgcagactgtgaatagccagtgaggaaatcccaatttttaaaggataaaggatatgcttttgcaaattcttttagctttttcggtgagtctacctccgggtccacgctaaaggaaatgatatgtgcatccaatttttcttcttttaaccgtttttgcagctctgtcatatgtgcagtcatcggcggacagatcgtttcacagcttgtgaaaataaaatctgccacccatactttccccttcaaatcatctaatgacacctttttcccatcctgattttcatattcaaacggctgtatttgataatttaacgcatctttgatttgtccatttgaacatgagactaaaagaagcacgcttatgatcataagcgcaccaagtaaggctctcctttttttaagcacggtacgtccatcccctttttcaagtcaatcggtataaaaagtaaagcctattgcgccttttccagtgtgacacgaaataatcggtgttgtgtaggcgatgtcaacaagtgcttcaggtgtatgatcaagcagcgctgatttgagcttttcagcgagttctaatgcatctgcatgcgctatcccaatggcttgaactgtttttcctttcaccgcctgtacatactgtttggttaaatagcggacaagagcagaatagcttctcacattcgcttcaggcgtatataccccgtctgttaagctggcaattggtttgatgtgaagaagtgagccgatcagcgccttccctctcccaattcttccacctttcacgagattttctaatgtatcgattgtgacaaatagctttgtttcaagacggattttatccatttctttgataatatcttcacggcttgcaccattttgtgcaagttcggctgctttggtgacttgaaaccctaatccataggaaataaagtttgaatcaatcacggtgatgtttccgtctaccattttcgaagcgctttcagcagtttgaactgtaccactcattccgcccgttaaatggatactaatgacttcgcttccatctgccgttagtttttcatataattcgacgaattgaccgatcgcaggttgagacgttttcggcaattcttcagcggcctccattttttcgataaattcatctggctgtatattcactcggtcaatataatcaaccccagaaatggagatattgagcggaatcacgtgaattgaaagatcattgattttttcttgcggaagatccacagtagaatctgttacaattttaatttgtttcactatcgtctcatccttgctgtcttagtctttacttatgatattaccttatttagtgcgtacttgaaaacaactgtcagaacgtttttgaaattgtcacatttgcttgtttgcatgaaaaaaatccttgccaaatctgagcaacagccattttaaaacagccgctcactccctttgacaaagattccttttttacgcattgtgtttcagtgtaggcttctgatagatctgctcatatgtgctccacttgacgttacgtttcacatcctctctgaaagagtacacagctctctttcctttagatacatagacttttttcaagaaagcttcaagtctaaaggtgagcatgaaacgatacggctcatctccctttagtacaggaacttctgttaccttgatctgagctccatccatccgtctaaaacatattgttttgagcagcacaaacgatcaatcctcttttccaatgttctgttacgcctaaataaataggtggaataaatcttgatctttattcacttcaacataatggaatccttttttattcatccgttcaatgagcgccgcatagtcatctctttctttcaattcgatgccaacaagcgccggtcctttgcttcggttattctttttcgtatattcaaagcgggagatatcatcatttggccctaatacttcatctaaaaactcccgaagcgcacctgctctttgcggaaaattgacaatgaaataatgttgtagcccttcatagatcatcgaccgttctttgatttcctgcattctgccaatgtcattatttcctccactgacaatacagacaacatttttccctttaatctcctcgcgatgggcatccagcgctgcgatcggaagtgcacctgccggctctgctacaatcgcacattgattataaagctctaaaatggttgtacatactttcccttcaggtacaagactaattttatcgacaacagattgtagcgatgtaaacgtcttttcgccaatccgctgaaccgctgctccgtctacaaacttatcaatggaatcaagtgtcacaaccttacccttttcatgggaagcatggagtgaagctgcgccaagcggttcgacggcaatgatttcggtttctggggcgatatttttgatatatgtaccaacaccagataacagacctccacctccaacacttgcaaataaaaagtgaggctccacttcgatatcatttaatatttctacagcagtcgttccttgtcctgccatcacatccaaatcatcaaacggatggataaactcgcgcttttcttcatctccgcatttcactgcttcatgatatgaatcatcaaacgtatctccggttaagataatttcaacatattcttttccgaaaagctctacttgagatactttttgccttggtgtcgtagcaggcataaagatttttccgtggatacctagatatttacaagaataggcaacaccttgtgcatgatttcctgcacttgcacaaacaatgccgttttttagtttatcttttggaagctggctcattttattaaaagcgcctcttaatttaaaggaacgaactacttgaagatcctctctttttaagtagacattacattcatatcgttcagaaagtcgctcatttttttgaagaggtgtatgaatgactacatccttcaaattttgatgggcctttaaaatgtctttcacttgaattagcgtgttttctttgagcaacggtttcatgtacaagatcctttctctttaaccttatttaatttgtcattataacatgaatattcaaaaaataaaccaatagatcatagatcaagcataaatttcataaactttttcgtttctctgtacatttggttttattgggtgttacaattgaaccaattagaaccacaaagaaaggaatcacccgatgaccacacattcatttacgtctatatatggagagcaccaagaaatgaagcgtgccattcacctggcaaagcaattcacaaaacacgagcagccggtcttgatcacaggagaaattggcacaggtaaaacacgatttgcccatgaaattgctcatgcatcggctccaaacgcttcactgacacatctatattgtcccatcctagatgaagataccttgcagaaagccttcactgaaaaaaaacgtcaaattctttatttagacgaaattgccgcattaagtattcctatgcagcatcaggtcattcgttttctagaaatctctcctgcaacaaaaatcattgccacttcgtctttatcaatagaggcattgagggtttcatctacctttttacctgagctgttttatcgcttaaacgttttccatttacctttaccgtcattagcagatcgaaaaacagatattcctgtgttaacaactgctttctttcaggagctgagcatggcgcctgatattgatccaagtgtttgggaaaccttgcaggagtatccgtttgaaggaaacgtacaggaactcaaaaatatcgttcattatgctgcagtcattctcgaagggcagacggtatttttacatcacctgccgccttttgtattaacccctctttcgccggaggtaaaaggaaaaaaagaagaacatcagctcactttaatggaaaaacaagagtttgttttcctactggaagccattaaatctctcaatgagaaaggtgaagcagccagcagacgcatcttgtctgaattaagcaagcaaggcgacatcccgctgacccctcagcaggtaagaagccgattagatgaccttgagaaaaaagcatacgtgacgaaaggaaagggcagggccggcacgaagattactcttgaaggtctttcattcctgaagtcacttgatggttatataccggttcaataaaaggaggacatccattgtttactgtaaaagaagaaattgcaaacgccattacacatggcataggcgttattttatccataccagccattgtttttcttgtgttattcgctgttcaatacggcactgtcacagagatcgtaagcttttcaatatttggcgcatctatgctgctgctctatttaagctcgaccttgcttcatagcattcggcacaaaaaaacaaaagatgtatttgaaatcctcgatcactcggctatttatgtattgattgctggtacctacacgccctttttactaggaccattaaaaggcgcactcggctatacgcttcttgcgattgtatgggctcttgctgctggcggaattgtctttaaaatctttttcgtcaaacggtttatcattgtgtccacccttgtttatttattaatgggctggatgattatcattgccatcaaaccactttacattgggttaacaggcccagggtttggcctcttactgttaggcggtctattgtattcagccggaaccatcttttatatttggcggaagatcccctatcatcatgcgatttggcacagctttgttctaggcggcagtgcatccatgttcttctgtattcttttctactgtgtgaacattcctgctgcatgaaaaaaaccagcatccgaaagtggatgctggtttttctatgcgcgcttttgggcgtaatcgctcatcatgacaggtgctttaatatgaatatcaacattcacagggtgcagtcttttcacgactttcccagttaatagacgatctgttccacttgtttcaatcggtacaagcggacaatcacaatcttcaccaagtgcctctgctatgtgacgctgtgcttctgaaagcaatacactctgcccagataagattttttcctttgcttcttctaataaagcattatcagattgattctgatgaataaccgccatcttcttcagccattgttttaaaataggatatcgaaaaagattcggctttgccatgaaagcaaatggtttctcaaggtgaccaatcaataatgccgttgtggctggattcagtgcctgtgtgatataaataacgggtccatccggcagcttcttttgctggtgaatggtcatgactgatcctgactgatcaatacagcccctggcaaacctttttgcatgctcatgaatgagatgcattcgtttcgtataggaaatgcgcggatcagttaattcatgggcatgcaaatgcctcatacttttaaaaagggatacaacaacataaatcgttaaaaaccaataacgaaacaaccgtactcctcctactcatttatccttttttgtcataaacgacaaattcataattgtaggggttcttttcgtcacgatggcctttttcgcgtgatacaaccgtccattcgttttcatcgtaatcaggaaagtagcggtctccttcaaacgcatgatgaatatgcgtaatatatagacgatccgcatatggcatcatttcttcatacagcttagacccgccgatgataaataactctgtctcgctttttccaattgccaaaatatcagcaatggaatggacaacctcacatccttctgcttcaaaagaagaacttgttgtgagcacgatattacggcggttaggcagcgctcgtccaatggattcaaacgtttttctgcccatgacaatcgtatggccgcctgtgaccttcttaaaatacgctaaatcagctggtaaatgccagggcatttgattatcttgaccaatgactctgtcttttcctgtcgccacaatcattgaaatcatacactgacttctcctttgatatgcggatgtggatcatagttctcaagtacaaaatcatcgaacgtgaaatcgaaaatgctcttcacatctcttgtgatgcgaagctgcggaagcgtgcgttcctcgcgctctagctgcatgttcacctgcggaagatgattctgataaatatgtgcatctcctagcgtatgaacaaactctcctggctcaagatttgtgactttggcaatcatcatcgtaagaagagcatatgaagcaatattaaatgggacgcctaaaaagatatctgccgatctttgatagagctggcaggaaagcttcccatttgatacgtaaaattgaaacagacaatggcatggtggcagcgccatttgatcaatttcacccgggttccaagcgctgacgatcagtcttcttgaattcggattatgctcgatatcatggatcagctttgtgatctgatccacagtctcaccatccccactagcccaagatcgccactgtgccccgtacacacggcccagttcgccattttcatctgcccattcgttccaaatacggacaccattttcctgaaggtatttgacatttgtatcaccttttaaaaaccacagtaactcatgaataattgatttcaggtgcaatttctttgttgttaacagtggaaatccttcctgcaaatcaaatctcatctggtaaccgaacgtgctgattgtgcctgttcccgttctgtcacctttttcatccccgtgctgtaatacatgacggcataactctttgtattgtttcatttttttcatcctttatttatgttcttgttgtagtttaccttatttctgcttttgtttaaaccaaaaaaacatgcctgcatgaggagcagacatgtttttctttttatacttgattcactcgatcctgctcttcatccttaatatcttggtgtgagtgagcaatacgactagctgctgctgcagctagcgcggcgacaaggtcatcaaggaaagtatgtacttcacctgggcgaccttcatctaattccctaataatgccaaacttctctttatctaaataaccgaagttcgtcaaaccgattgatccatatacattgacaatggaaagcggaataatctcatcaattccatatagcggctcatctgtttcaactaagtgctgcaaaggttctggcaatagcttttgttcagccagctggtcaagggcaagtcctgttaaaactgcatggacaatttcccttttattcaacactttctcaacattttcaatacagacactaagtggaaggtttggatggtatttttcttgaagctttagcacaatgtgtgcaatatcttcaattttcactccacgttcgtttaacatttgttttgtaatctgcaccatttcgttcattgtatattttttcaattggcatgacatctccttctagtggctcatccagctcggcggggtgtttttgtcccagtaaatattaccgagttcatgatgcgtctggaatccatcttctgctgtatggtagtgaaagttaaaccaatatccgctgtgtggcggctgatctcttctcacatgaaaacggagcaaatcttctccagtcttccgattgtagatgtgaaagattttttcgccatttccgcttgaaggctgatcagttaacacaacatcttgaaatttttcgtcatctttgaaatttgttaaaacatcggttaacacttgttcaattttcggttgaatctcttctctgtactcgtcttcaatgacaggtgtgattttacggccgaatttgagaaaggattgattttctgcacttgatagaacctcttccttatatttctcaaaggggtctacctgctcttcgcttgcctcttgcgatcgttcccagctgcgcaattcatctgatgtatcataaaccgctgtataaggcgttttatcaggtgaagaaagttcagatggcttgtctgtcatcaaagccgacggaggagaaaccaaaccaaaagttgcaattgtaaagagcgcaacaagcgtttttctcatccacatcttcatgatatctaattccttccataagttatcatactgctattctagcatataatgaattttcagtcattcaatttggtcactgatttgagactttctttttcataataaaacgtttacaataacagtacaggcaactaaaatttgggaggaatgggtatgcttgaaggctttttcatcacagcttccttgctgacactgttttattttgtctatatggaaattacggattaaaagcccttagtgagggcttttttctttctcgatatacccataatgaaattgggctgtttttcgtttgatgacatgaaattggtaagagtctgctataaatcgtgtgcttttccaatgatcttttaacaccactctttttcttgccacccttaatgcttcttgcacggctgattcgtgatcaaagtcgtgctctgccgcatgacgcagcggcgctatacttgtagattcttgaatcgtttcctcaaacatggggtcaaaatagacgatatcaaatgaacagtcaggatacttctttagctgctcgatactgtctccactgataacagaaatccgtttcatcgcttcatcagcttcctctattcccgtctcccatgtattcagtccttctcgcactagtaatgccgtaatgggattcttttcaataccgacgacccttcccttcctgcctatcgcacagcttgcagtaatcgcatcagaccctaagccaagtgtgcaatctaaaaaggaatcgcccggctttagctgtgctgcttcaattaaaggatccttttctccgcgcaagagccgcttcaccctgaacatcgctgagcttggatgaaagaagaacttttcaccatttggctgataccattcaaatctttctttcccgacaacaaggacatctcctcgtttcaccgcaagctgcttgacggattgtttgcgtctttctacatactcaccatgtaaatcctctgcaagacccttcgctgtttcaatcgtttgttcatttgctctaaagcttgttgtaatgagcatatcgttcctccatcatgatcaagaaaaaatgccctgatctagttacagggcatttcaacacgtgtattagcaatgtttttcgaatgcagttaagacatttttcatgatatcttccatttcatgaccttcaatttcgtcacgcgggataaaatgaacgagttcatttccttttaaaagggccatagaaggagatgatggctcttcacctgtgaaatattctctcatttttgccgtggcttcccggtcctgcccagcaaatactgtgacgattttgtctggcgctttttctgccttcattacagcttgagtcgctgctgggcgcgctaatcctgcagcacagccgcatacagaattaacaacaacaaatgttgttccttcagcctcttgcatggtttgttctacttcttcttccgtcgtcagttcttgaaatcctgcacttgtcagctcttggcgcattggcacaacgagctggcgcatatattcttcatatgccattgacataaaaaagccccctctaaaatccttatgttgtgaataaaggatactatagagagagccaattttcaaatgttctatttcagattaaattttcatgattccgcctgtattggctgatgtcacaagttttgaatatctagcaagatagccagttttcacttttggttcaaagcctttccagttcgcttttcgtttttcccattcttcttctggaacatcgacgcttaaaatgcgctgttcaatatcgacgacgacatggtcaccattttcaacaaaggcaagcgggccgccctcagctgcttcaggagagacgtgtccgatagacaagccgcgtgaagcgccggaaaaacgtccgtccgtaattaaagaaacctttggtccaagtcccatcccgacaatttgcgaagtaggagcaagcatttctggcataccaggtccgcctttaggcccttcatagcgaatgataacaacatgtcctgcttctacttttctattaatgatgccttcaagagcttcttcttgggattcaaatacgatcgcaggcccttcgtgacgtgtgatcccatcttgtaccccgcccgttttaataatggctccatctggcgcaaggtttccaaataaaacggctaagccgcccttttcagtaaatggtttgtcgattggataaatgacgttatagtccttaacctcatgacctgcaatgttctcaccaagcgttttcgcggtgacggtcattgtatctaaatgaagtgcgccttcttttttggacaattcatttagcgcagctgtgacgccgccggcttcatgtaaatcctcaatataaacatccgatgctggcgcaagttttgataaatgaggcacacgctctgctacttcattgatacgttcaagtgaatattcaacacctgcttcatttgcaatcgccagtgtgtgaagaactgtattcgttgacccaccaagtgccatatctaatgcaaatgcgttatcaattgctttttcagttacaatatcacgtggtttaatatcctttttaatgagctccattagttgttttgctgactttttcgcaaattctcttcgctctggtgatgtcgccaaaattgtgccattcccaggaagagcaattccaagcgcctctgctaaacagttcattgagtttgctgtaaacattcctgaacaagatccgcaggtcggacagccaaactgttctaattcatttaattcctcttcgttaattttacctgactggtatgcaccaacgccttcaaatacagaagaaagagaaatttttctgccatcacttgttctacccgcttccatcggtccaccgctgacaaagaccgttggaatattgacacgcatcgctgccatcatcatccctggtgtaattttatcgcagttaggaatacaaaccatgccatcaaaccagtgagcagatacaacggtttcgacagagtcagcgatgatttcacggcttggtaatgaatatctcatcccgatatgccccatcgcaattccatcgtcgaccccaattgtattgaattcaaatgggactccgccagcttcacgaatggcttctttcacaatctttccgaattcctgaagatggacatgtcctgggacaatatcaatataggaattacatacagcaataaatggcttgccgaagtcctcatcctttacccccgctgctcttagtaagcttcggtgaggtgctctgtcaattccttgtttaatcatattactacgtagttctgccatctgtttaaaaagcctcctatactacaagtcttgttgactgtatgattttgagttgattttattttacaaattttctgtttatttagccaccgatgaatgactgatgaccaacatggctgctgaagctagcgctcagcaaggttcgtgtcataaaatctgacctccaatattctatattggtactactatatagagttttttcgtatatttcaacaatattcaaaataatttttctaaaaaaatttttctgtctatgactttaagaaaaacaagctgcctatcattggcagcttgttcaaatgtctcatcattctgatgcattttttctactttctgtcatttgcttccatactgaacctttcgcttcttctccgtgctcaatgcgctcaatcgccattttcacttgaaggctgacttcaaattcagggtcttgctcagcttcttttaatgcgtcaagtgctgtttcgtcaccttcttcataaagaaacatcgctgcacgccagcggacaagcttacttggatcctttaatgcttcgatcattgcttctatagcgttcgggtcaccaaggtctgaaatgcagtctccagcggttctgcggaccgtcactgttttatctttaagccctttatataaaataggcagaatagcaggatcttcaatcattccagcattcacaacggcttgtctgcgaatggatgtttttgggtcttccattgctttcattaaaacaggtatatccttttgctctggctgcatttgctctagatgggcaaaacgctttttccaatcttcctcgtgcagcatatcttctgttacatcatatgcctttcggttcacttgtcgatctacagcttcttgaccttctttgactgcctctgttaagcgtgctaaacgctcatcatcataggctgcttgcagctcttctgtgacttcctgaccgatatctgcaaagtcaccaaaacgaacgccatgttctttccacacacgttcaaatacgacattgtctgaactgcttctgagctttaaaatagctgcttggaagcgttcaggcatgccgaaccgctcttctctttcaccgtctgttaatttgacttgcatcggaatcccattaaacatttggacaaacactttgacttcgccaaatgtgtcaccaccagactgcactccttcctgaaggccttctgattcttgaccaaaggcttctctgacctgctgcaaaatgccctgccagtcatactttgcattacgctcaacagctaagaaatctgcgacatgataaacaccttttacaccttcaatgttcaaaatgcgcttgatcatctctggcgcttcgtctttttgatcctttttgtaattgttgcttttaccgccggcaagtgcttctgtcaaaatgaccttcatcgtatttggacttggcgtcggttctatcgctgttattttcatctatacatcctccttacacacataaagacccaactcatctgtaaggccgcattcttctttccatgtcttgataaataggctcatcaaatcgtgccgctcctcagcaagcagctttcctgtacgagtgttcatgaagtcttttaatttgagcagtttttcttccatatgttttagcacggagccctgctgcctgccctttgaatagtggggttccccttttgcgcctgcatacgtaaacaccctcgcaataccggttgctcctatcgcatcgagacgatctgcatcttgaacaatagccccttctaacgttattggtctattctgcttatgtcgatgtcgaaaagacatcgttgtaatgatgtccatgatataacgaatatcccgcgtatgaacttcccaagaaaggagctgaagctcaagccgctttggtgaaagctgccattcacccggcagcttttcatcaatgacatcatgaacaatcgctgccatttcaatcacaaacagagagccgccttcctgattagcaatttggcgggcaagctgccgcacacgatcaatatgagccgcatcgtgtccagtaggttcatatttcagccgatctgaaacaaaggaggcagctgcctccaattgttttttctgcatgacggtaagcaccttatttgtccaaaagagcgatgatggagctttctaattcttttggtgatgttttcggagagaaccgctcagtgacttctccgttttgatccacgataaattttgtgaaattccatttcactgttttcgtcccaagtacaccttttgcatgacttgttaaatgtttgaaaagcgggtgcgcattgtcaccattgacatctacttttgcaaacatagggaaggtcaccccataattcaaagaacagaattcttgaatggcttcttctccttctggttcttggttcataaattggttacatggaaatcctaaaatttcaaggcccttttcatgatattgatcatatagctcttgcagttgtttaaattgaggagttagtccacatttgcttgctgtgttgacaataatgagtatttttcctttataatctgccattgatttttcttgaccgttaatggtcttgacctgaatatcataaattgacatctcatagcctcctaggattcactttttcctatcgtaacatgcttcttttataaaatcgctttttatgcttccggttaaaagagtcctgtcacactgccgtcttctaataaatccatctcgagcgcagcaggttttttaggtaatccaggcattgtcaatatgcttccagttaaagcaacaataaatcctgctcctacagatggttttaactcacgaatcgtaatggtgaagcccttaggtctcccaatcaaagctggatcatccgaaagtgaatattgcgtttttgccatacaaaccggtaaatgcccccagccgtttgcctcgatggctgccagctgttttcttgcttttgaagtgagtgtgaccccgtctgctccgtaaaccactttggcaactttagataatttttcttcgatggcatcatgctcttcatacaaataggaaaagctgttcttcttcttttcaataagtgttgcgagctcttcggcgagtgctgtgccgccttcgcctccttcttcccatacattcacagccttgactgggtggccatgtgcgtggcaccaatcttctatcgcttgaatctcttcttttgtatcagtgataaacctgttaactgcgacaatgtacggaagaccaaaggattggacggtttcaatatgcttttctaaattatgtataccttttaatacagcttgtgcattctcttctttgagttctgttttcttcattccgccatgcatctttaatgctctgactgtcgccacaatgaccactgcaccaggcttgaaatcaccagctcttgttttaatgtgcaggaacttttctgctccaagatctgctccaaatccagcttctgttacgacataatcagctaatttcgccgccattttagttgcaattaaactattacatccatgcgcaatattggcaaaaggaccgccatgaacgagggccggagttccttcaatcgtttgtacaagatttggtttgagcgcgtcttttaaaagtaacgttagaacaccttcatatccaagtgcgccaacagtgactggctccccgtcttgattataggcaacaacaatagaagaaagacgttttttcaagtcggttaagtcttctgctaaacaaaagatggccatcatttcggaggcaactgtgatgtcaaacccgtcttctctaggatacccatttacctgtccaccaagtccgacaacgacctgtcttaatgcacgatcgtttaaatcaagcactcgcttccatacaatgcggcgcgcgtcgatgccaagttcatttccgtgatggatatggttatcaataaacgcagataaggcattatgtgcagaagtaatggcatgaaaatctcctgtaaaatgaagattgatttcttccattggtagcacctgtgaatatcctccacctgctgcaccaccttttatgcccattgtaggacctaatgaaggctctcgcattgcaatgattgcttttttccctattttttcgaaggcttggccgagtccaactgtgacggtggacttcccttcacctgctggggttgggttgatggatgtgacaagaatcacatgtccttctttttgttcttttaaacggtcaaaaatagtcaaagatattttcgcttttgtgaaaccatagcattctaattcttcgtcatgtatttgcagcttagctgcgatgtcttgaataggtctcagctttgccttttgggcgatgtcaatatctgataaatgctttgtgatcataaataaacggcctcctttttttcgagaaacagctttgtttttgctctgtttttcattgtaacataattgaaacattgaaatatcgccagaaagttcctataatgaagtgaaattagctttgattcagggggtggcgagttgcctattaacataccagttcatctgccggcaaaacaaatactagagagcgaaaatattttcgtcatggatgagacaagggcattcaatcaagatatccgtcctttgaatatcgtgatcttaaatttaatgccaaaaaaaatacaaactgaaacgcagctgctaagaatgctcggaaattctcctttacaagtgtactttacgtttttgattccaagtacgcatacaccgaagaatacgtcgagagagcatctagatgaattttatacgacctttgaatcgattcgccataagaaatttgatggaatgatcatcaccggcgcaccaattgagcatttagcttttgaagaagtatcctattggaaagaactgcaggagattttagactggagtaaaacgaatgtgacgtctactcttcacatttgctggggtgcacaggcaggcctatatcaccattatggtattgagaaaatcaagcttgctgagaaaaaatttggtgtatttgagcatcttgtgaaagagaaaaaagaaagattagtcagaggtttcgatgaagtatactatgtcccacattcgaggcatacagatattaatacagaacaattaaaaaatacgccgaatttgaaagtattgagtgtctctgaagaagcgggtgtttgtttaattgtttcagatgatgataaacaagtatttttaactggacatcctgaatatgatacggacacattgaagcaggaatatgaaagagatttgttgaaggatgatacagtccaaaaacctgtccactattttatagaagatggtgacacattagtcccagtgaatcgatggaaagcccatgccactttactgtttatgaattggctcaattattatgtttatcaagaaacaccatacgtttgggaataaaatagactgtagtctgatgataaatggccaaaatgtgttaaaatacaaatggctctgtcttccattatcaatttagtcttgttgttttttaaaattagtttaattctttcgtaacgaatgatatgctctggttgtttatatgttatctttatgtatatgtagacctatgagattaatagttttcgtacgaagttttgttgttgttgattacatttgaggtgaatattcttgaataccaataaaaaaatattaatcttgaccgcaaattatggaaatggacatatgcaggtggctaaaacactgtatgatgagtgtaaatcccaaggatttgagcatgttgtagtttctaatttgtatcaagaatcaaatcccattgtgtcggaagtgactcaatatttatacttgaagagcttttccattgggaaacaattttatcgcttgttttattacggtgtagataaaatttacaataaacgcaaatttaacatttatttaaaaatgggaaataagcgtcttgatgaacttattcaattacacaatccggatatcattattattacattcccgatgattgttgttcctgaataccggaacaaaacaggaaaagtcatcccgacatttaatgtcatgacagatttctgtcttcataagatttgggtacatgaaaacatcgaccggtactatgttgcaaccgattatgtgaaacaaaaattagtggaaatcggcacacatccaagcgatgtcaaagtgacaggcatacctattagaccacaatttgaagcagacgtgccaaaatcgaagatttataaaaaatatggattatcatcaaacaaaaaagttcttctgattatggccggtgctcatggtgtactgaaaaatgtcaaggaattatgtgaagcattgcttctagacagtgaagtacaaattgttgttgtatgcggaaagaacgcagcgctgaaacaatcactaagcgatcttgaacaagcacatccagatcaattgaaggcgcttggatatgtggaacaaattgatgaattgttcagagtaacagattgtatgatcacaaagccaggcggcattactttaacagaagcaacagcaatcggcgtcccagtcattctttacaagcctgtccctggacaagaaaaggaaaatgctcatttctttgaagattatggtgcagccattgtcatcaacagacatgaagacattttagaatctgtgaccaacttactgcaagatgaagaaaaactagaaaccatgaaacaaaatataaaaaaacttcacttaaagcattcttctcaaaccattttggaagatatcgttgagcaatcggatctcatcacgaataataaaacgtatgctcgcgcattatcataaaaaggtgtccgtcattgacggacaccttttttctttatccttgatttccatttgttgtgtacacttcttcaaacggctgcacgacaacaaatccgcttccgctaaacttcatttgaatagactcaccgcttcctctgccaataaaggttttgaatgaaacatctgtcacaaattcagtttttaaatcccctgaccatgcaactgtcgcattcggatctgtgcagacagagtcacccggctgaacaatcaatgtgagcggctcataatgactcgtaatcgcaacaaggcctggtccttctaatttgaaattaaataatccacccgcaagcatccccgatacttttttcatcaatttgatatcccagcggactgaaggttcaaatgcgagcagatcattcccattcacaaaaatggattccccttgagccaggcgaagaattgagatttttttgccttgatctgctacatataatttcccatcacctgttgccttcatgagtgaagtgccttctcctgacagcatttttttgaacatctttgagacgccatgctcaaacacgccctctcgttcaaatttgattttgcctcggtacgaaaccatggaacctgtttttgcccaaatggtatcagtcaaattaatttctaaaagtcttggtgtttcaagttcgaagaccccttctcccttatcttcctgctgcgtattctgaacaaattcttcgagtgtataacgattcatgatagcacctctttctgtattttttttatatacggacaaactgtgcataaagtttcagaaaatggggacggttcagctataattgttatttgtcaaaaaaaatcaaacattctgctcaaaatttggctctcccgcttgacgctttacttttgatggtgtatagtggaaccatcatttaacaactgcaaagtcgttaggtgatgaaaattttttttagtatgcctaaaggtatgctacagtactaggaggaaaaagcaatatgcaaaacggtaaagtaaaatggttcaataatgaaaaaggtttcggcttcattgaagttgaaggcggagacgatgtattcgttcacttcacagctatcgaaggtgacggttacaagtctttagaagaaggacaagaagtttcttttgaaatcgttgaaggtaatcgtggacctcaagctgcaaacgtaacaaaaatctaatcaactaaatcaatgatgcaaaataaagagaggcttatgcctctcttatttgattttcagctgaatttcaattgctaaaatattttgcttcagtcgttgttcaatttcagagatatctttttcgagaaaaggtcttcccttctttgccacatctacaagttgctctagatcgctgtacacctcttgaaatgttcgatgtaataccgtttcgaactccttattattcataccggccttccccttttcctctaatatccgtcacttagtcaaaaagtaactcaaccaaaactttctatagttatatcggctcatttttcgaaatatgttctttttttacacattctatccgttttttttcaagaacggatgtttgagcagggaaaaccggtgcgtcctcttattttttgagcagcgtttgcccatattcttttattttctctccaacggtgcattgctgtatacaaaaggaatgggcatattttttgccaaattcttttcgaaaatgcttcttaatcaaacaatctgaacaatacgtgtcttgaagatcagtcaattcttgtactgctgtttttttatccacattattcagctccgtctgcttctaatttcaatgtactttcgattgggacgtctgcaagaatctgtcttgcaagctgatccgcttctgcattttgtttccgatcgatggcttcataggttggcgtcagcttcagctcttttaaagccgcttcaattcggtcaagccatttgttatgtacatcatcataacaaggccattctccttttaactgattcatgacaacaagtgaatctcctctaatcgtgacagaatttctgcttgctcctagatcttttaaaacttttactgcttcaaataaagccgcatactctgcttcattattggtacttccttgaaaaggttgattttttctcaatcgataagcgtcttttcctagcttatagtagacgacaacgccaagaccagagtcacctgtttctttatgaaaacttgcatcaaaatagacttgaagctgatcaggctcaagctttaattcttcatttagcttttcaagctcttttatagaccacatagcccctttttcatcttcaaatgacagaagagactgtggttcttttttgtcaatatgtttagctaatctcaaggcctcttttagctccaaccaatcttcttggtaaaaaacaatggacccaattgatttcactttcattgtgtagtgtgctcttaatttcattgatcacatcgccttcccgtgcttttaaggtaaacatacgttatgctataatcaaaaagttacattttacaatgagaaaggaagttcatgtcacttgtttaatgaaggtatttggatcttatttgcgatcattaattttatcattgttcttctattttataaaggatttggcaagatgggccttttcgtttggattggctttgcgacggctgccgctaacttacaagtggtgaaaaccgttgaattgtttggcttaacagccacacttggaaatattttgtacggcagtgtcttttttgcaacggacgtgttgaatgaaaaatatggacaacatgaagcgaaaaaagcggtatggattggttttacgacccttttaacactaactgttgtcatgcaggaggctttgcttttcgatcctgctccatctgatatctcacaatcatcgctggaaaccatatttggttttatgccaagggtggcactcggcagtctcgctgcttatatcatcagtcaaatgctagatgtttatgtatattcgtttattcgccggatatttccctctgatggtgcgctctggatgcgcaatgctggaagtacgatgattagccagcttcttgatacactgatttttacgaccattgcctttcttggcacgtatccaactcaagtatggattgaaatttttatcacgacatatgtcattaaatttatcgtcgctgcgatttccacaccatatgcgtatgcagcgaaaaaaatggttccgcttgatgaaaggatgaagtaatttgccagctgaaatatacattgatggtgcgagtgcaggtaatccaggtccttctggcatcggcattttcatcaaatatgatggaaaggctgaatccttctccattcctcttgaatccatgagcaatcacgaagcagaattttctgctctgatcgaggggatgaaaatttgtgcagaaaaaggattgcgtaccgtttcatttcgcacagattcacaagtagttgaccgcgcagccaatgcaggatttgctaaaaatccagcatttcagcattttattaaagagataatcgagctccaaagccagtttgatttattttttattaaatggattccgagtaaggaaaatcaagtagcagatcagctcgctagaaaagcgattcacctttctaaaggatgaatcgctttttttcggttatgctaatgtgtgtgaggtgatactgattggataaagaaaataaaggtcgtgtcacaaatgggacaaccccacaaggtgatgcgcaaacaaaagataaacagccactatctcagctggaaaatagagcgaagaaaagcaatacaaaaagataaacctaagagatcggctttagctgatctctattgtatttaaacgattcatcatcggttcgattcctttgatttgatggtgccttagcatagcagcagctcgttcttgattgatgttcattttcgcctcatccattggacagctgagcgggacatcacatttgatctctgccaatagacgagaaagtttcaaatcttctaatcctgcttgcattttcttttgctgtgcagccgttagttcatggacattttctaacaaaccatcaatcgtttcatatgtttgaataaatttcaaagccgttttttctccgattcctttgacacctggataattatcacttgcatcacccatgagtgctttcatatcaatgagtgcctttggtgagattcccatttcttcttcaaataaggcttttgtataatgcttataattgccaattcctttttgcatcaaagcaacagtcacttgttcatttaaaatttgcagtaaatctttgtcgccagtgaggacagtcacgcgtgcttctttttggtaaagcgcagcaagtgttccaatacaatcatctgcttcaaagccttttaaaccaatattcacaattcctagttcttctgtcgcttctttcgctaaatcgaattgcggaatgagctcgacaggcgcctctccacgatttgctttataatcttgaaacaattcgtttcgataggtttgactccccatatcccagcagcacacaatatgagttggctcaaatgtctgtacagctgttaataagtgcttcaaatagccattcactccatttgttggcacaccgtggtcatttatcataaaattgcgatggacagccgtcgcataaaacgctctgaacaaaagcgccattccatctacaagcagtacgtgtttactcattcttataaactcccttttcaaaacaatactcctattctatcacagaacgcaaaactagacataaaaaaggcgccttcttcttttggaaaagaagaggcagcctgtttacttttgaccatattgcatttttttcgattctgcttctgcataggacggcatgtctttttgtttagggtcacgctcatcctgctgctttgcctgttgcttttttttcatgatcattcccctttctcggtacattcattaagatgaccaaaaaagagaatgttactctttacttctgtttgcgctcgacatactccctgaccatatcattcgtcacaagctttcgcaatggaacaataccgcctcgtgcaagctcattcatcttcgacgtaatggcgttgatctcgtctgttgtaaatgactcgttttgctcacatttgacaacagccatctctattgcttgttctcttttatgttcaagctcaagaaaggactggatatgggcatgctgcttttgtgagtgtgcggaaatctcttcgtgtacgctcgtcattttgtatcaactgctttcttttttatttagtctaccatgaatcaaatggttttcaactggttcttccactcatttatttgttcataaacttgttcaataacggcctgctctttgggatctgttgttaggctcgtgataaatgtttgtttttgttcacttagctgctcgagcgcttctgtttcatatctttccgtaaaggtcttcaccatcatatcgtacctgctcagtaattcttctttttctttatctgcccatttcatggttaactgatgaagaatgtctcgaatcgcttcaataaacgcagccttaccattctgttcaaagaaaactttcgctgatttttgtttctttaagagcggttcgaatggtgttagttcagcttcgacttcaatttgttttagttcagcatttttctcttctggcggcgacagcgagagagaaaagtaagggtcttctgcacatgccttctgcaatcctttctcccactcctcttggaagtattgatgaataaacgattccatccgaatatcaagcgcctttaactcctgtataaattcaaattcataatcctttagcgccttctcaagcgcttttttcaattgctgtccgaaattcccttgagatattccaggataaaaggctgtctttaacagatcattcgcaaatagtgataggcgctgcacaatatgatagagctgttcatgtaagtcctttttcacgctttctgtcactagcttagattgttttatatggctcatttgatcaagaatcgctccataggatgcatctatctttttcttttccgcttgcttctcatcttctgactgatgcagcgtcgcatgcagtttgtcgactgttctacataatgtaccggcttcaaaatataacagctcgatcgcatctttcgttaattcttcctcaataaaatagtcgagctgctttctaagctttgcgtattgattataagctgtctctccctttccttcgatctcttccttactggagacatgatgaaggttagggtttcttatgccttcttttgtgagctcattttttacatagtcaaagacggtgtcaagctcttcttgatcctttgcgagatcagctgcattgataataaagaacattttatccatgctaaatgaatcttttacaagcccaagcttacgtaaaaatgaccgatctgccttcgaaaaagagtgctggtagtaagttaaataaagaagcgcatctgcgtccttcatatattgaaaagcaatctctgtatgacgcttattcatactactggcgcctggcgtatcaacaatagtcagccctttatctgtaagaggtgtactcaaataaaccgtcacttctttcaccacacaagaaacagcttcttccgccacgtatggcctcagttcttgaagggtgacatgaagcggcgtttgcttcgtaatgtgatgaaggaaacgagtatgtgcctgtaaaaaatgttcaacaataacgcgatgatcttgttcaagctgtctttttttcagggctcgttcgagcttggatgtaaacgtctctcccttttcttctgagatcggaaatcctaggatctgattgagctcctctaatatatcctgttctgttttgaacaccactttgacactttcatgcggatgaccttctgccggccgcgtcagcttattaatggtagccgttgttggtgtgggagaggatggcagcacctttctcccgacgagagcatttgcaaaagaagatttccccgaactaaaagccccaaataaagcgagtgtgaattctttcgcttgcagccgttttgttcgtttttcaaaggacttcctttgagattgaagcgcatctaatggcaataaaatctgagaaagctgctcaaattgagcaatcgactgtgccgtcgtgacatgctgtgactgacgcatttgaggttgctctatctgcttgttcggtttatcttggtcgctctcttcaggatgaatggtcacttgatcctgctttagctggtcatgctgcatttgtctctttttcgcataaaaccaatcttcttcgatcttttcatccgttccattttgccatatatcccatacatgctgaatatctcgcttcatttgttcattttttctggtgcactgctcgagtgtttggagctcttttgctgactgagcccatttttcttgctgtcctgctttatcttccatcagcttggctttcagcgactccaccatttgttcaatcagtggcatcacttgctgcttagcctttcttctcaaggcttcgccagcatcttttgcatattgcagtacgtattcattagagaacgttgctccatgatgaatcacactttcaagaagtgattcttgtacaggcgtttcaaacgccatcacttgatttaataattcttcaccaagttgatgtttcttgacttctttttttagtagctcagcaatatgccagtccacttctgccttcattctcgttttgacatctgataagaagtcatttgcgcgtttttctttttcctgctcagttttatttttaacaaaaagcagtcccactttaaagccaggtgcttttgattcaatatagccgcttgcgagttctctcattttaaatggagtgaggttggcatttttcaaaatgctctcgacttcagtagatacttcttcttctaactgtttggccccattttcaatgaagtgatttttcgcttccaattcatttacttctattcttttttcttcgagctgtgactcaagctcctcaccttgcaggtcttcttttaacgagtcaatgtgttcttttaggacatgctcaattttctgctccgtataagcccgaagtgaggccttcggcaatgtctgtaattcttgcagttttttgactaaacgaatcatttcatttcttggatgggtctcatcggttacagatgtaaagtatagatgttcttcttcaatgccttctttttgaagcatatcaactacttgatttttgtagtcttcaaacgctgtctcatgctcatcatgccggtcgacttggtttacgatgaaataaagatttggcactttctctttaatggagcgaatgaaacgaatgttttcctccgaatgaacatggttgtagtgaacgacataaaaaagagcatctgcttgatgaagaatagacgcagcagataaaaagtgggcatgatccgtcgaatcaattccgggcgtatcaatcagtgccactttttcttcaagtcctctatagtcaccgctaatttccaccatttcaatctgttctccgtccttacagaaacgctgtactgcttctttatcataagagccgctcatttttgcaaatcggccatcagaggtatgaagctgaacttcactttcgcctttcctcacgacgaccaagtttgcacttgttgggattgggctcgttggcaaaatgtgatcatgaagtagataatttacaagtgatgactttccagcagaataatggccggtaaatgcgatatatacttcttcttctgcttcctttttgataatcgatgcaagtttggctgcgcgctcataatcatcccttttgagaaagctttgatataaagctcctgtagtttgaacgagcgaatctcgaatagacaagtctttcatgacgataaacccctttgtttttagaaaagtcagttatgtatgtgataccattttacacaaaataaagagatttttcttctgatctggggaaataaaaaaatctgctgcccgatcagtcgcagttgactggaatcaggaagcagattttttggagacaccttttaatacgaagccaattaataggctgtatacacacaccgtaccgagtaagaaaatcattgtcatgtgatcaccgtccatccttcatgattgagaatgcttatcattaatgaaagtgtagcacaattgataatgattttcaatattaatttagcaaatactgatttaatgctttctcctctgtttgaattcgtacagccatcatccatgcatttaaacatgtaaacaaaatgccagtgacatatgcatcaaacaatagcgggatcagtataagctcaatcgccacgacgacatagttagggtgtttcaaccagcgatacggccctttttttataatcgttgcgtttggaacgactaaaatctttgtattccagtacgtccctagggagcataaagcccagtaccgaatgatctgtgtagccatcagcaaaaggagcagtacaagaaaatactgggatggccctttatgtaaaagcgttatctcaactatcagtgagagaaaaaaagccgtatgcatagcgaccatataaggataatgactagcaccaaattcaatggcacctagtgcttttactttcttttcatttcttttggcaacaagcatttcaatgagcctctgacaaacgaaaaaaccgatgacaagccaaatgatcacgccaagacctcctcccatttcataagcagcaactctgaggaaaagcccggaccaagcgccccgcaaagtcccatctcccccgcttcagcagattgatgttcaaggaaatgcttgatgacatacaaaactgtggcagaggacatatttccgtgttgtttgagtacttcttttgaagaaaacagctgattttctcgtaaagatagactttcaacataggcatcaatcactttttttcctccaggatgggctaaaaaaacggacaagtctttagttgaatatccatgttcctctaaaaattgatccacctgctcttttaaccagccggaaatcatcgacggaatgtcacgggagaaaataacccgaaagccgtcacttgtaaaatcccagcccatgacatcctcagaatccttcattgtgacggattgcgtgcttagtactttagggattgtttttaaatgggcatattcaagcgcagctttttctccagttaaaagaaccgctgccgtcccgtctccaaataaggaggtgccgattaaattgctttttgattgatcttgcggctgaaaagttaaactgcacagctcacaggcaacgacaagtacctttgcttctggaaatgcccttatgtattcataagcccgagacagccctgccgcaccgcccccacaccctaggccccagatcggtactcgttttgtatacggagaaaaaggaaggacgttcataagctttgcatcaagacttggggtcgataagccggtacttgaaataaaaaacaatgcatcgatctcttcaaccggaactggctttttcagaaacgtcttctcttgaagacaatgtatgatcgcttcttttgcatgagtcaaggctttttccaaatagatattgtttttctcttcaaaagagtggtgcgtctgataccattcaatgggctgcacaaactgcctgctcttaatttctccattttgaaaagctctcagtagccggtcaatatctttaaacgatcgtttaaattgagaccttgcaaattcggcagctattttctgatccacatgatgcttcggatgactcgttccaactgaaagaatgtacgccatcggcttcacctcttttttcggttaatatcccctatcgaaaaaaggatatacatgccaaatcgtcacaattcagtcaaaacattttcctccgtctaactttttgtcttgacgacaattgataaatattggataatataaatgaaaacatgatgtagttttcctccttcacaggttcgttccaagccaagcgaacctgctttttttatgcaaaaaaacacctctaaaagagaagtgttcagaccgtagacccccctttacttatacaacactttcatacggaatctccccttcgcttcgcatttatggttaaatctgatgctatcttagcgtatcaatattaacgtttcgatcattattcagaatgatttcatttaaacatgaatggatcacctttttttgctgatcaacacaaaataataaccataaattcctaatttatttgaattttctatattaaaaggattttttccactatatacttaatcaatatgatcaccaagaaaaacagtgaaaaaagacagaatctactacatgattcggctcaaaatttaattgactggagtgattgtaatgaaaaaggtttccaaaaaaaagacaccctacaacacggtacttctctcaaaggtaattggtttagtgcttcttacactgtttcttttttttatctgggatatgtctaaagcccatttgcaggcgacaaacgggcaagcaaaaaatgttgccagcagtgacttccgtgacacaagcatcaatctgaaagcaaaagatcagtctacaagaacattggatacacattttaagaccaatccaaaccaacaggcaacgaataaaacggtctttttaacatttgatgatggtccttctgctacatcaaatcagctgttagatgtattaaaagcacatcatgtgaaggcgacgttcttcatgcttggaccgcaaatccaagcacaccaagcagctgtgaaaagactttatcaagaaggacatcaattggggcttcatggcatgacgcatgatataaacctcttttatcagaacagtgagtctcccgcaaatgaaatgagagaagctcagcgcattcttgcttctgttacaggcgtctacgcccgtcttgtgagaacaccctatggcagtgttccaaatttaacatatcatcaaaaagtacgtttaaaccaacatggctttatttactgggattggacgattgatagccttgactggagatataaaaactcacaatatgttccagaggtattgaatcaattgcaaatgtttgagaaaaataaaccatgggaaccaaaagttattttaatgcatgatcaaccctctaccacaaactatttagatagcctgattacacagctaaaagcacggggctatacatttgcagtcattaacgaaacaatgcagccggtacaacattaatagtgctaatcacaacaagcccgtatccaaaagatacgggctttcagcgtgtagacaaaccctcacacgctccttcctaggatcctaggacttcaaaggttttttatcaagctaaaaagaagacaaagagctaaaataaagatcattttagctctttgtccatcatctaaacccctctcttggagaggggtttacataacagattgcttaggctcttccatcaggtcctgcccggtttcttttttaaaaggaatcatgtgataaataatatgaagtaaaatagcggtaaagctgccggccacgatgccattacttgttaataatttgattgattctggcaaatgctcaaacatttgcggcacaacggtgacacctaagccgatcccaactgagcaagcgacaatcagcaggttttcctgtttggcaaaatccacacgcgagagcattttaatcccgtaggcaatgaccatcccaaacatggcaaccattgcgccgccaagaactgactttggaataatcgtcgtaaatgcagcaattttaggaaaaagtccaaataacatgagcaatgcgcctgtcacaacgatgacttgatttttcttgacccctgtcaactggatcaacccaacgttttgcgagtaggctgtgtaaggaaaagcattaaagatcccccctaataacacagcaatcccttctgcgcgatagcctttcgctaagtccttctcttttaatgaccggtttgtcaaatcacctagtgcgaaataaacgcctgttgattcgactaatgacacaatcgcaactaacgtcatcgtcataatcggtgcaatttcaaaggtaggcatgccaaaataaaatggttcaatcatgcgaaaaacttgagcgttcgccacctcagctgtttccactttccccataaatgcagcgacgcctgtcccaaggagaataccgattaaaatggcgatcgccttcataaagcctgttgtgaatcgatagagcagcacaatgataaacagcacaaggaaagcgaggcctaaattttcaaaagaaccataatcagcacttccttctcctcctgccatattgttcatcgctactggaataagggtaatgccaataatggtgacgacagaccctgtcacgacaggcgggaaaaatttcacaagcttcccaaagaaaaaggaaagcagaatgatgatacaccccgaagcgataatacttccatagatagacgaaatcccgtatttagagccaatcgcaatcataggagaaaccgcagtaaatgtacagcctaatacaacaggcagaccgataccaaagaaacgatttttccaaacttgaaggagcgtggcggccccgcacatgaaaatatctgctgagattaagtaagtcagttgtgcaggtgtgaggccgagtgcatctcccacaatgagtggtacaagaacggcacctgcgtacatcgccagcacatgctgaatccctagcgagagtgttttggcttttttagctgtactcatgattgtacctctcgtacaaacgtgactttcccttcctcaagtgattcaatacgtgcaagggattcgacgcggtagcccatttgaacaagcgcatctcttcctggctgaaatgacttttcaatgacaatgccaaatccggctacttttgccttcgcctgctttgcgattgcggcaagtcctttagcggcttcaccgttcgccaaaaagtcatcaatgattaatacacaatctttttcaccgagatgcgtatttgagacagcgatcgtgctttctactttttttgtaaaagagtacacattcgctgttaataggttttctgttagtgtgagtgattgacgttttcgagcaaagacaacgggtacttgaagagctagtccagccatcacagcaggtgcaatgcccgaagattcgattgtgataatttttgtaatgccatcatgcttgaataatctagcaaactcttgcccgatctcatgcattaagacaggatcaatttgatgatttaaaaaggcatctacctttaacacttgatttgacagaacgattccttcgttctcaattttttgacgtaacaattccatcattcttcctcccagcatattggcaaacatttttatttttcgcataaaaaaagcattgctgtccatgaggagcaagcaatgcgaaaacgatccacggatcttcagctcaaacaagagctgtttcatttgctcactcatagtcggacggtatcggtgtccggtagaaacttgcgtgccatcatcacgcgattatatgagtgttatagtgttcaaattataacaagatttcagacgcttggaaagcacttttctagaaaaataccgaacttaaataataaatcagatcaaaacgttcgtttttagaatattcaagcatcaaaaaagcacccttctgagcaaagggtgccttttatttaagataaatacagtttcgtatatttatcagttaaataatcgattaaatattgtacatttaattcctcaccagttgcatcttgaatgatttcagaaggctttttgcgttttccatgctggtgaacatgtgttgtgagccattcttttatcggtgcaaaagacccattttgaatcagctcatcaaaattcggtaaatctttgatcatttggtgctttagttgcgccgcatacatataaccaagggcatatgaagggaaatatccaaagctaccatcagaccagtgaacatcctgcaaaataccgagtgcatcattaggaggcgtaatgccaagatatgctttatatttttcattccacagtgcaggcaggtcttcaaccgccacttcttcattgaatatcgctttttcaatttcatagcggatgataatgtgaagcgggtatgtaagctcatctgcttcaattcgaatataagttggcttcgattcattcactgcatgcacaaagtcttctaaagagacatctttaaattgctcaggagacgcttcttgaagcttttgataatacgttttccagaagtcttcatgtctgccaataaaattctcaaagaaaagagactgtgattcatggatccccattgatgtgccatcacataataacgttccgctcagcgcctcatcaatgttttgctcatagatggcatgaccacactcatgaatcgtgccaaagatcgccatccgaaaatcatgctcatcataacgggtcgtcacacgaacgtcccctctgctcaatgtcacagcaaacggatgaaccgttgtatccagacgtcctgcatcaaagtcatagcctaattcttttaagaagaaaagactcagttccttttgtttgtcgatcggaaagcttttcgataaaaatgaagtatccggtttatgaggagaggcttcgatttttttcacgagaggaacaatggcatcacgaagtgcaccaaacttttgatcgagctgttcaaccgtcatatctggctcatagttattgagaagcacatcatatggcgtttgtttcacgccccaatattgaataaaacgcttgttaaaatcaatgagctgttttaagtatggagcaaagagtgaaaagtctgatttctcccttgcttcaacccagacatgctctgcttttgattgtaaaatcgagtattctttaaattcttctttcggtattttgctgttttcatcatactctttttgtgataattcgagcgccttttgtgtatcttttgacagctcatctcggtgtttatttaatgcatcaagaagatctctcatttcatcagaagtcttcatattaaaaatatcacttgataattgaccgatcgtttcagctctgaaatcggcgctttttttaggcgcctgtgttcttgagtcccaataaagtaaatggagcgcctccgtatagtgggcgatttttcctagtaattgataaaacgctttctcttgtgcttcaagactcatacgtttgttcccccaatcgataaatatgtatgtacgtttcaaggctacttcaaggaatgttcttttgtcaatgaaaaaggagaatacgcagatggtatcctcctctcttttttcgttatatattatttaagatgtgatgattggctttactggcagcacggattcaattttactttgaagctctgtatcttccttacggtcaaagtaaatatgaatggttcctgcatcttggcttgtccgaatcagtcttccaataccttgtcgtaagcgcagcagcatatacggaaggtcgacttcagcacgggcatcctttgcttcattccgtttcgcctcaaataccggatcatgaggcgggtaaggaagtccccagatgatcacatttgttaatgattgtcctggaatatccagcccttcccaaaggtgaacagagcataacacagatgtctcatccgcttgaaacttttgaacaatcgtactgatttcctcgtctccctcaaagtacacgtcgaaaggcagtgattcatctgatgcttcaagctgctttctaaagaaatgaagttcatcaaatgaagggaacaaaatgagagaccgtcctccattatctttcagctgagtgatcacttgctgtccttttacttcttgctcttgaagctgctgaatcccgtggaaataaatcttcatttgttcatcgtaatcatacggcgaagcgacactcattgataagtagtcttttatcccaagactttcagctaaataatcaaaggattgattttcagacaatgtagcagaagagaaaatgtatggtcttttttgcgagaataccttttcaccaagtacctctgcgacagtctttggcatcacaacaaatgtcgtatctaattcctgcttttcaagccagctaatcgcatttttttgataaagcgacaaagaatacgccatttgttcaatgtactcttctacaacagacaattcgtattgatcgattgtatacatctctgattcaaatacgagtgcttctccgattttttcaagcaactcacacaattcacttgcagaacgcttcacctcatccaccctgccaatttcaagtcgatgtgagcccttgatttctttggcatgtgtttttaagagataaaagaactcatcgtttgtggcaagtgcatcttcaacgagctcggcaaactcttcgcgtatatcgttttgaagcaggcgctctaaaaaggtttcgagcattgattgcttcactcggtatgtcagtgctttttgtgcggcaaattcaagaaggtgcccctcatcaaatacaacggagctatgttctggaagcagcggaagctgaccctcgcgtttgcgggattccttcgtccacacatgctccatataaaaatcatgagaacagatgatgaggtctgttgctttccggtaatgatctcttgataaattcaaaccacagcgatgacgcatatcgcacgtcaagcagtcctgaaacgaatcatagccaatgcgtgaccattcatcattggatagctctgggtactcttttcgatcaccatacggataaaagttctgcatcccatgtgattcatgaacaaacgaaggaagcgtttcataaatatcgagccacttctcatcatcttcacgctgcatggttttctctaatttctttaagcataaatattgatcatgcgatttacttaatctcgcatctatttgaatatcaaggtgattagcaattttatagatatcaccctcttgtttcactagctgttcaattaacgtttcgtctgcacatgcaataatcgcaggtttccctgtataccttgcatatgtgaccgcaaataatagataaacgatggttttgcctgtgcctaccccagcttcggcaaacatcacacttttttctttaaaggctctttctagttgaaaagccatgaatatttgttcatctcgaagatcaaagcccttttctggcaaaatgtcatagaacacatcaccaatccagttgcccagttcttcgtaaaaattatgttcttttgataatgaaaaaggcaaacgagatgctgtcacctgcttcaacccccaacttttgaatcattcagacattctatagtaacatttatgctggggaatgacaatcttttttatgaccgcaaacgatgttggtaggtttccttcattaaaaatgcatgctcagatcgctctatgtaagcctgagcaagcgctaaatcttcgatggctgcagtcaactgagcagattgtccaccttcttgcccttcaatttcttgagcagtcgaagcgagtgctttttggattaactgaaattgatcatattgtatcatggagacacctctttttttaaaatcaagttcagtttattccgtcccgtgaaggtttatacctttctgcgataaaaaaagccacaccttctgtaggtgtgaccattttttatgattcagttgtctgttttctaggcgggcgttttccccaatattggtaatagtctgttttaataaaaccattaaacagttttctctttttcgttgcttttctaccaaagcactcttcgaactgttcgtgtgacgttaagatgtaaatggaccatgtgtctaggcttttaaatgcttcgcccataccttgatacattttttcaacagcaggtttatcactgagtcgttctccataaggcggatttccgacaatcacaccgtaatcttcttttgtttgaaagtctttcacttgcatttgtttaaactcaatcaattcacttagtccagcttcttccgcattcatttttgcaatgtctatcatccggtggtcgatatcacttgcaataatgtggagcggctgatcatagtttgccttttcttccacttcgtgacgcgccttgttccatacgtcttcaccaatccattcccatgactcggatgcaaaatcccggttaaatcctggggcaatattttgtccaatcatggccgcttcaatagcgattgttcctgatccgcagaaaggatcaacaaacggacggtcaggtgtccaattcgttaatagcacgagtgcagccgcaagggtttctttaataggtgctccgccttgatccatgcggtacccccgtttatgaagacctacaccagatgtatcaagcgtgagcacagctttatcttttaaaagggcaacctcaattttatactcaggtcctgtttcttcaagccattcagactgtatgttgtaagaggagatgagcttttgcgcaatcgcctttttgacgatacgctgacaatccggcacactggcaagctgtgatttcacagatttaccgatgacagggaacgtgctgtttttcggtaaaaaagcggcccagtcaatcgcctttgtgcgttcaaacagctcatcgaatgtttttgccgaaaattcagcgacttgtacctttattcggtctgctgtacgcagccaaaggttcgcacggcaaatcgcaagtgcgtccccttcgaaaatcacttttccgttgtctactgtgcattcatagccaaggtctcttacttcttttgcaacaatcgcttcaatccccattggagccgttgcgataagtgtataggttttcattgatttatcacctgttttctcgtccttttatgtattccaagataaaagctctccatatgttgaaataggagagctttgttttcatcatgtttataataacggatataacgttctgtaagccatgttttgttccattgtactgcaaacggcaaatgcctcgtactcaggtggtaatcatctatctacagaatactctgtccttctctccgtttggttcctttgagaaagttcccctaccaagtttgggtttctcgctcgaggggtttaccgcgttccactctcaccatttctagtgagacttcgtcactgtggcactttcaaggatactttgccatatcctaaaaggacgtaggcatttttcctgccgtcagcctttcccaggctgccctggcttattttttcgccaggcacgaacactacgggcatctcagcaccgtgcgagcatggactttcctctgcaatgtctaaacgcattgcagcgattacccgaacgttaatcaacatgcgttattataaacgacaatgacatgaggcacaagctttttcagcaaggctcaatcataaagtttgcttccgaaaacgtgtttctcaaggttagatagtctttttaaaatatcaaagtttgttgtattagactgtgcaggctgtcttttcccttgctcaacggcttcttcaagctgttttgacaaatggaggttttcttgttgaagcttttcgatttcttggttgaaggtctcatagtctttaatgaccatatctaaaaatttatcgacttcttcttgtttgtatcctctgacacctgttttaaattctttttctaaaatttctttcgcagaaagctttactttatcagcaagcatctttttcacctcatatcgtgaattcatagtatattttttcagaaatacgtgacgttgtcaaattttctcttgcttttagtcaaaaaacggatcttccgcctcaacttgtgctctcaaatcatccattgtgatgtacataatggggtaatcggtatagttttccgcttctttaatcatgtactttggcgagccatcatgctccggatcataaagggcgaggagtccatctgttttttcaataaaaaaacggttcttttgtttaaattgtgccggactttcatacggtctatgcgtgacactttctacaaaatcggcctgggcaagaattccttcatacaactctttgttttgttcattccagcgctcttcctgttcataaaatggcgtaatgacggcaagttttaacgctggatactcctcttgaagctcaaatactacttcggccgtccagatttctgcccctagctggcctgatatgagaacccactcgaggccatcttcaattaaagctgtcagccttttttgaagctccgcttttatgtattgaagtgcaggctcgtcttgtttgaatatcccaagctcaaatggcttgtaccctgtgacagcaataattttcattttttcacctgcttttaaaaaaagggacttataaaagtcccattccactttatctgttacagcaaggtccaccgcagttaaagtgttgatgtgttgctgggtccacctgagaaaacgtatgcgggaagtagtgaacatgtttgaaattttgatggtgaacatttgtcacatgttgcggatggatatgcggcacaattgttgttgaatcactgtgtgtacagcaatgattcgtcggatgaacaattggctgtgtaacattaggctggcaatgatgatgatggtacatgtagcattcccctctccttaattttcttacattaacaatgtatgaattaagaggtgtacatgtactaatgcattaacctattttaaaagtttgcaaggaaaacatccttatagtttgaaaacacaaaagcgaccaaaatgacaacaagaaaaaacaagtagaaaagacccttatacatgttctacgctcctcattcaatatctaacgttattttacaggattcgtgacttttctacaataaaagtgctaaacaatttttattttcggtcgagagccgaacgttgtcatgttttgcgctttcccgggcaataatgtttattgcccagcttttctcaatagccgtttttttcgcttttcaagttcttcagtttctcgctgacttaacgtagaaaaagataataacgattcagtaacagatagagctgatcttgcatctttttcacgatgttcttgatacttcgcaagctctatacccgcttttaatgctaaatggacatcgcttgatgcaaataatttctcccaaatttgaaccgcttgatcccactcgttttgtcgtttatattgcaaggaaagatcataagacgcctgattcgcatgctcaaagtcagcattcgttaattcctgcaaatgcttcgttgcttcctgtacatcacgatgagcaagatgccacctagcgagcgcatatttctcattgtgttcctttaccgcatcctcagatagtatttttttggataggtgaatgtagaggctgattaacgataagacgtctagttcattatgagtcaagattccttcaatcagcttcgggttttgttcctttaaaaaatgaaaataaatcatcggtgccaaaaaccccggcgtgtcgttttcacgctgcacgtgcagctcttctttttccacaacggatagcgccattcgttcatatttatgcttccacaatcgtctagatccgtgcagaagatcaaaatggccgtattcaggaagtgcaggaatttgacctcgtaaaagcgtatgtctcgttttcacttgcggccaatcgaatgatttaccattatatgtaactaacgattctacgtttacttcatccagaaagcttttgtaaagagccgcttcatttcctggattggtgagcaggtgctgtttcaccaccactttgcccgaaaagacacgtgcgtgtccaagcaagaagatcatatttcccgtaccgccagataatcctgttgtttctgtatcaaagaaaaacagctcgtgcggctcgtaccctttagccgatagcgaatgctggatgccgctttcgttccattgctcaatgattttcggcagttccgcaaacgaatagcgcccatgctgatgatctaatgagtaggtaacttcgcgaatcagacaaaaggactcctcaaaatgataaggagacacacctaatgcttcccattcttttaaaaatgggatattttctgaagtcacaggctgaggtattccttccgatgttttctgccggttttcatgtgtctgattgtgcgatagatgctttttcattctgtttaatttcccttttaaagacatgagcaggtgtcccctcctttcccttaaaatacggacatcaattcaacgatgctgctttttccgttgacctctttcatttccatgccaatgcaggatggacagccattgtcacagcggcaccgctcaatgagctgaatggctgcgcctgctatttcatcgaagcgagcttgtacttccttacttaagccgattccgccagggtaatggtcatataaaaagaccgtcggttttccggtatgtgccgctttaatttgtgaaaccacatgaatatcagaacggtcacacatcacaaaagcaggtacaatgtgctgaagaacatttgcaatgcctagaagcagctgttcaagagttttctcttcaaatctcagctctgcctcatgtaattcaaaccaagcagcactcgtatgaatttcttcttccggtaagtgaatcggtccagacccgatattttcaccggtactcagacggatttttttaaaaatcgtcggcattgcgttgacggtcacatcaccgtagtgaacagatacagcttccttctctgtcgtctgatcgatttcaagcaccttaagttggacggctaaattcgcatctgtatagtattctacatctacttgtttcacataagccttcagatgctcgtaatctagcttttccacttgatactgaaccccttcgtgtaaataaatggcttcatcatgaagaagcgtcatcgcactgaaacggtccatctcgccaataatccgaacattcgccacatctgattgatccacaattacgacattttcctggcttgcagaccggaggctgatgccatgcgctgggaacgattgatctgaccaataataccggttcccgctaaaatggagaacgccttcctcatgtaagtattgcaaaatctcttctacgtccatgccgccaaactgttcatcctcccgaaacgggagctcgtaggatgcacattttaaatgatccactaaaatgatgaggttctcagggttaattctggcagcttcaggtggtctattaaagaaatattctgggtgtctgacaatatattggtcaaggggtgaggagcttgccaccatgataatgagtgcttcctcatgacgccttccagcacggcctgcctgctgccatgtactcgctacactgccaggatacccggtcatgatacagacctttagctgacctatgtctacacctaattctagtgcgttcgtactgacgacacctagaatgtctccttctctcaatcctttttcaatcacgcgccgctcttttggtaaatagcctccacgatatccacgaattgattttggaccgatttcttttttcactagttcttgaatatgacttaaaatcacttctactcttactctgcttctagcaaaaacaatcgtttggattttttcctttaaaaaagttttagccagttgattgacgacagtggcagcactttgtctaatatttagtggtttattcacaactggcgggttgtaaaacacaaaattctttttaccgctaggtgccccgtttcgctcaatcaaatgcatcttgcttcccgttagctgctgcgcaagctcttttggatttgcaatcgttgcggacgtacaaatgaaaatcggatcacttccataaaaagcacaaattcgttttaacctgcgaatcacattggctacatgactgccaaatacgcctcgatatgtatgaagctcgtctatgacaatatacttcaaattctcaaacaagctgacccatttcgtatgatgaggcaaaatggctgaatgcagcatatccgggtttgtgatgacaatatgtcctgcttgtctaactcgctgccgaatggcgggtgaggtatccccatcatatgtttcactatgaatcggaacatccatctcgtggatgatctcgttaagttcactcttttggtcttgtgcgagcgcttttgttgggaataaataaagggagcggcttgtctgatcttctacgatcgactgaaggacaggcagattgtagcaaagtgttttacctgaagctgttggtgtgacagttacaacatgctcctcgtccatcacacgttcaaaggcttccttttgatgaatgtagagttcactcacgcctcgtttctcaagcgcctttttcagcttttcgttcactctttcaggcactggagaggtctgtgcgggcttcgcttcaatttcatgccaatgttctacctgttcatctttttttaattcttctatgagttcgttcattgttttctttttcatatcgcatcacctctcttacatagtgtaccgaatatttgtttgcatgactaggcggcaattttttgatgcgcagcttatgagcaaatactttgaagtgttgtaacagtatctattacacttctatagtgaaatgattttatcaaggaagaagatgatgagagtgaaaaacgaatttaagcctttatttgaaccatttacgtttccaggaggtgcgtctattaatggccggttagtcgttgcgccaatgacacacttcggttctcacgaggatggcaccatttctaaagaggaaattgatttcattacagctagatctagtgagatgggcatggtgatcacagcatgtgcaaacgtgactccagatggtaaggcatttgaaggacagccttctatcgcaagagatgaagatatacccggtctgaaaaaactagcttctgcgattcaggcaaagggaacaaaagccatcattcaaattcatcacggcggctctcaggctctccctcacttagttccaaatggtgatgtggttgcgccaagtgatgtgtttaaagatggaaatcagatagcacgcgctttaaaagaagaggaaattgtccatatcattgactcttttaaagaagcagcaagacgagcggtcgaagcaggatttgacggcgtggaaatccacggtgcaaacggttatttattacagcaattttactctccgcatagcaatcagcggacagatcagtggggaggaaatgaagaaaagcgtctagctttccctatcgctgttgtggatgcagtgaaagaggcaatcgaaaaacatgcgacaaaaccgtttatctttggatatcgattatcccctgaagaaccagaaacacctggtttaacgatgacagagacgtttaccttagtcgatgttcttaaaactaaaaaccttgattatttgcatatctctttaatggagattgactctaaagcaagacgcggtgcagatacggataagactcggatggagctgctaaagaatcgctgcggcgatacacttccgctcatcggcgtaggcagcgtgattacagccgaagatgcactaaatgcctataaccaaggaattccgcttatcgctgtcgcacgtgaactgatcgtcgatccagattgggcaaagaagattaaagaaggcagagaaagcgagattgaaactgtcattaaacgaagccaaaaagatcagtatttgatcccagaaggattgtggtctgttatggaagcgagtcaaggctgggttccgatggaagattaatgtcagcaaaaaaactaccctcatgcgattgggtagtttttttgtcctgattattttaatttaacggtaaaaagcttagatgtttgtttttcaacagatccctttggctctttttcgagatgctcgatcaagtcaccattcataatgacaatcggtgtcactgtgcttgacgctttctcttcaatcagttctaaatcacacgtaatgagagggtcaccgatcttcactttatctccctctttgatgtgcgcttcaaatccttcaccatttaatcccactgtttcaagtccgatatgaatcagaagctcaagccctgagagtgttcgaatgccaattgcatgttttgtatggaagagctggatgatttcaccctctactggtgacacaatcgtaccactttttggtttgactgctacgccgtctcccatcatcttttgagaaaaaacagggtctggtacatccgtcatatccattaactctccatcagctggagaataaatgatttcttcctttacatcatcttggtttttcccgaaaccgaataattttttcagcaatgtcaattgctcccttcaagctttgcttctagatctattccgtgtatgaaacgatacgctcatacaccttgcttcattcaacactatttaatcataattttttcctctcatcaattgataaccgcctgactcctttctgcataggctgtagatgagaggtgattcaaatggaacatgaaggcgaaaagaaacatgaattgctggcaaatgaagatattctctatgaagcgattgaacaatttttcgcatcctccccgtttcatgagatattaaatagtgcggaggcgctcatgaccacatcgcattcacttgcatcgattacgaccgatgtgacagaggatgagcagtttgtgtatatcgcaatccaatttcccgaccattttgttgaaggcgatatcgcgctagaagtaaaagcccaatatttacacttatccgtgcaagaaacaatcaaaacggatacaacttcctcgtattcgagctttacaaaaaccattttaatgccggcaaaaatagatgaaacgaacatgaaaagcgtgtggaaagatcaaacacttcgtgtaacggcaccaaagcaaagagcccaatagatccttctattgggttttcactatgctttaaaaatgctcgtaaatcctttcgctaatgagcctacttgattcatcgtactcatcatttgcccagctgtatcaaacattttgttaaagtcgaattgtccattcgtttttttgaattgcgatagcacacttttaaattgagatgattgctgtttttgcggtctaggcaaaggataagggttcataggctgctgcatgggcatcatgcctggtggctgcatctggggttgattgatcgcttcgggcggctgataaggcggtccattttcttggtatccataaggcggctgatagacagcaggtgatgcctggctcatgccaccttgatgtggcggcatgaaatattctggaggctgcggaggctgctgctgcatttctggatacggaaaaggcccttgattgaatggattgaattcatacggctgctggtttgaataagggatcatatatctcgctcctctcgctctcaacacatagtcttgtcactcatatattatgatgaaaaacagaagatgtgcctaaagcagccataagaaaaacgcagcgatatcttcagctgcgcttgttaatttcttctattaaaaggttcagtgtgtaaatcactgactcaactaaatttttcacacggggtgcatgctgtttgccaaaataagattgcaggacaacctctttcccattttctttgacggcttcaagctgttcttcgtgtaaatatctaggtttcgccagatgaataaacgagatcgcagcagtgagccactcttccattttctgatcaaatgtctcaacggctggctgaatttctgtgtgaaaatcataaaccggatattcctcttcagcctttcccttttggtactgctcatacgcctcttcgatccatattctcagctcttgtgtatgtttaagtaatgtttgattatccaaagtgttcacctctatgaaccatcctatcaaacgtttacttattgctcaaatagaaagctaccctgcgtggtatgccggtcttgccgccagttgatactcagctgcgtgaatcttcacttcacagtcctttacttccgattcaagccggtctatcatttgctcttgctcttctatggctgcacgtgttgtttcgttcacagcaagagacagctcttcttccaccgcatcaatttttcgctcgatttcctctaataactgcaaaatggattcttttgatacaaattcgctcatcatcagattcctcctttatcgtctctcgttacattctcttttctttcacaccctccttcacacatgacaaaactagaagcaaatcgccaatctaagtgtagatgagcgctatttctcccttttcgacatatgcttgtccttctttgtatgattgcgtccgattgtgtaaattctaaggacaaaggaggtagatttcatgaaaaagcagccagcaccaaaagagcaaaaaccaaaagggaaagaaaacagtacagatcagcttgataaaaagctcggcggtcctaatcgaccatccacgtaaaaaaagcaggtaccccctgctttttatttatgcaaaaaatagtgctctaatgagaaaagaaaacgaagctgtctttttttatgaaaataccagtcggtcagctcaatttgttttggcagcgtctctgcatcaaacaaagatgggctcaatttcttttgaaaccaatcttctctttgatcgtctaatgaatgtgtcatcactggataaacagttcgaagaaaaggtgttgacctcctagcgatccctaaaaacggctcaaaatcaaaccgtgatccggtatgcggaacagtatgcaaaaaatgataaaaatccgaaaataaatcggcccgaaataatattttcgctagttttttccctaatgtaatacgctcctttacgtgggaaaacttccgtatggttaacccgtataaatgcccgtccaccgttggaaaaacaacggtttgaaaatgtccccactcgctgaacagatattgaatcgagtgaaaaacattctttttcagaagaggattttgtataataggagattgtatagtatattgttcatttatgatgagtgcataaagcaggcgctctgtgtcacgctttaaccaaaatcgttcccactcagtgctcataaaacgagatacagaaaaatacggaagcagatgaaacaagggtttgccgcaccgcttagaccattcatataaaagaagctgagggtaagcatccgaaaagatcagccaattcgctctttcatatgctgtgaaaaaaaggtgcccctcttgatctgttaaacctggatggaagagctcgccctttagatccgtcatagaccatccagcatttctcgagacaaaggaagcaagcagcgaccatttcatctctggatgacggtcataaaagcgcttgtaagcatttgtcctcgtcaggttgtctttatttttcactttcgtttcacgcaatatatgctgagtgatgatgtgctctttttgtgacaacataggtatctctccaatacaaaatgcattaaaaggaggctgaaacttgatgattcggtatccaaacggaaaatcgtatcagcccattcaaccaattgggacaaaaaaaagaatcagcggcgaatcctcttatagtaaccgcgggatgacgcttgaggctgacttaaatgaaaccaaccagtactatttggtcaacgggatcgcagtcattcataaaaagcctacccccgttcaaattgtgaatgtggattatccaaaaagaagcgctgctgtgatcaaagaagcctactttaaacaatcatccacaacagactataatggagtgtacaaagggcgctatatcgattttgaagcaaaggaaaccaaaagcaccacctcgtttccgctcaaaaatttccacgaccatcaaattgagcatatgaaacaggttgaaaagcaaggcggtatttgtttcgttattatatccgcatttggctccgtttattatttgcccgcttcagatctctttttcttttgggagcggcagaagctaaacggccgaaaatccattagtaaagacgaattagtggaagcaggccacttaatgacacttggatattcgccaagaattgattatattaaagtagtggagacacttcatttttcggatgaaagtgagtaacaatgacgttcgaaaaaggtttaacacgaaaggttgagatgtgatgtctgatcaatttacaagtcgtgaacagcgacgtaaagcaagtcaagaaaacaataagaagcaaaagaacaaaaaaggcaaaaagaaagcaggtctatttaaaaaaatatttttatctttactcgtgatcggtcttctatgtgtagtggccggaatcacaacttttgccgtttttgcatcaagcgctccttcaattgatgatagtaagctcaaaacaccgtattcttcaaagctttatgacatagacaagaaagtgtttgcagaagtcggtgcggaaaaaagaacgtatgtctcgattaaagatatacctgatgtggtaaaagaagcatttattgcaacggaagatgcacgtttttataaacaccacgggattgacccaatccgtattggcggtgcccttgtcgcaaacgtcgaggacggttttggagctgaaggtggaagtacaattacacagcaagttgtgaaaaacactctacttaataatcaaaaaacgttaaaacgtaaagtacaggaagtatggctctcgattcagcttgagcaaaagtactctaaagatgaaattttagaaatgtatttaaaccgtattttcttctcgccttatgcctatggtgttgggaaagcggctgaacaatttttcggcgtgacagatttaaataaactaactgttgcacaggctgccacacttgcaggtatgccgcagagcccttctgcttataacccagtgaaaaatcctgaggcagcggaaaaacgccgtaatatcgtattaggcctcatgaaaaaacaaggctatatttcagagaaagactatgaagttgcaaaagcaacccctgtcaaaaagaccgtagtccctgctgataaatataagagccagaactcaagtaagtattctgcttacattgaagaagtcatggaagaagtacagaaaaaagccaaagtggatgtatcaacagatggactaaaaatctatacatcacttgatcgaaaagctcaggatcacttagatgatattatcaatggggattcagttggttttacgaaaggtatgcaggcgggtgtcaccctgcttgatacgaaaaatggtgaaatccgagctattggcggtggacgtgatgtaccagctggcggctttaactatgcgacagatgcaaaacgtcagccaggttcaacgatcaaaccaattttagattacggtcctgtcattgaaaacaaaaaatggtcaacgtatcagcaaattgatgatgcgccatatacgtactcaaacggtacaccgattaataactttgacagaagacatttagggaaaatgtcgatgagaagtgctttggcacaatcaagaaacatccctgccctaaaggctttccaagaagctggcacagacaatgccgttaaattcgctaataacttaggtatggacttaccgtctgacattccagagtcttactcaatcggtggatttgacgatggtgtctcctccctgaagatggctggagcctttagtgcattcggtaataatggatactataatgaaccgcatgctgtcacatctgttgaatttaatgacggtacaaagcttgaccttacgccagattccaaagcggctatgagtgattacacagcatttatggtcacagatatgctaaaaactgctgtccaatctggaactgggacacttgcacaagtaccgaacgttcaagtagctggtaaaacaggtacaacgaactttacacaagatgatatcaataaatacaatataccttctggcggtgcgaaagattcgtggtttgttggttatacgccgcaatatacagcagccgtttggactgggatcggtaactcaaaagatgcggacggcaaaatgtggctcacagattatgagcagcgtgttgccaaaatcgtcttccagcgattaatttctcaaattgatgatggaagcggctcatttgaaaaaccagacagtgtcgttgaagctacggttgaaaaaggatcggatccagcgaaattagccggaccaaatacaccgagcgataagaagacaacagaatactttgtaaaaggaacggttccgacaaaagtgtctgacacatatgagaaaaaagaagctgataagccttctgacttaaaagcagtgtatgatgaagagaaaaaatccatcacactgacttggggctatgatgacgacgcagatgctacatttaatgtaaaacaagcggttgataacggcggctataaagagattcaaaacagttctgctaaagaagcggtcatctctgatgtgaagcctggctctacttataagttccaagtgacagccactgttgaggatgttacaagtaaagcagcttctactttcctcaccatcaaggatgatgaagatgaggaagaaaaagcagatgatgagaacaaagaagaagaagaacctcagcagcctgacgacgagcagacagaccagactgacgataacaaaaatcaacctccaggcactgatgagcaaaagccagatgataaaaaagatcaagacaaagataaggatcaggatcaaggcggaaatacggaaaacggaaataatggttcttccgataatggctcagacagtacaaatgggaacggaaactcacaaactgacaataaagataaaaagaaagatgatgcgaaaaccaactctcaaagctcaaattcgcaatcaacttctcctaatcgaaaagaaaatgaataatgaaaagcacttgcctatatggcaagtgctttttttaacggttttgtctaatctttttaagtgcttcatattttccatactgcttttttagttctgtgtatagctcgtctagttgaataaagcagtgatattgagtcggttttagcaaaatgaactctaaacgttctgtccaattaataggagcaacaggaaatgtctcttgcttaatatgttcccaatcaagcgtttgaagtctctcccctttgatccagtaaaacacagcaatcatactgacaatcccttgcagcatatcatcttcttcacaccgtgactttcttgtttgaaaacgaggaagcattttttcttttaattcattccacagttcgaacatcacaggaacaaattcttctgtgttctgccatggaagttcatttgtaagaagttctgatgatagatcatatgcgagtggatgctctctaaggatgtctactcgatcgcctttcatctctacctttttcccttttaatttttcgacatatgcggaaaaaacaactgccccgctcatgccagcttcaccaatccttttttcagccttttctgcccttctctacacatatcaagaagcggacaagattcgcactgcggacgctgcgccttgcagtgatatctaccaaaaaagattaggcggtgatgcgtcacagaccaatcttcttctggcacttttttcattaaagtttgttctacttcgagaactgaatccttccagcggcagattccaagtcgcttgctgacacgttccacatgtgtatccactgcaattgccggcaccccaaaagcgaccgaaacgacgacatttgctgttttccggcccaccccaggaagcttcacaagttcgtcccgatcttttggcacctcgccgccatattcttcaatcagcattttgctcaacttttgaatgtttttggctttatttcgataaaggccaatcgaacgaatatcttgctgcaattcttcaagcggtacacttaaatagtcttctggtgttttatatttttgaaataacgttttggtcactttgttgacaagcacgtctgtacactgcgcagagagtgctacagcgatcacaagttcaaatggattggaatgaacaagctcacactcagcttctggaaacatatctcctataatatctaaacattcattgatttgtttttttgataacatgacttctcctttattggttattgctccagccaattataaaaaggaacttgtcgcttatatgttgacgtctcttcttttgaaggtggcgctttttgctgagaacggaaatgctggctatgctcttttgcttcttccgctgttttcagccctttctttttccactcaaacagaattcggtcgatataacggaaatttaattttcctgataaaaccgcttctcttaatgctaggcggatcatttcagcatcatgatggtcttgatccatccaaatcgagagtgtttctccttcaagtggggacagtggtctgccaaattcatcttcaaataaagcatataaagacttttcagcctgtacatgaagtttttgaccttccttcgcttgttttgcctctagaaagtcatacagcacgccccataaaggctcaactgagtaacggtcatgctgaataccagacccgtcttcaaacggctgaatcgaaataaatcctttttgaattaaatgctgaaccatatacgcacactcttcagctgaaatggtcatgccatgggatagctcttcaaacgtttgaaagaacacaccttgttcttcattcattttaatcttaagcatcaccatcatttgtgattcattcagtcctaactgctcataatgagcaatcagcaaattaggcaaactagtcgagcccatttgctgcatattaataaattgctgcctattcatcggatacacctcttcactttaagtatatcacgttttatttcacgtgccccttcaaaaaacgtttgaaaaagcctccatatgttggaggctttcacgtcttaaggatataaacggtttaataatcttgggaaaggaatggtttcacgcacatgcggcgctccactaatccaagcaactgtacgttcaagtccaagaccaaaacctgaatgcggtacagaaccatattgtcttaattctgtgtaccatttataagtttcttgatctagtccatgttctttcaatcttgcttcaagcagctctagatcatggacacgctcagaaccgccaatgatctctccgtagccttctggtgcaatcaagtctgcacaaagaacgacatcatcacgatctggtgcaggctgcatgtaaaatggttttaatgatgttggataatgagtgataaacaccggtttatcgtagctttcagcgatcgctgtttcgtgaggcgcgccgaagtcatctccccattcaatatcgtcaaatcctttttcttgcaagaatttaattgcttcatcgtaagtgatacgcgggaatggtgctttgatattttctaattttgcggtatcacggccaagtgtatgcagttccactttacagttttcaagtacactttgaaccacatgagtcacataattttcttgatactcaaggttttcattgaattcgacaaaagccatctcaggctcgatcatccaaaactcaattaaatgacgttttgttttagatttttcagctctaaatgttgggccgaatgagaatacttttccgagtgccattgccgcagcttccatgtaaagctgtccactttgagaaaggtacgcatcttcatcaaaatatttcgttgcaaacagctccgttgtaccctcaggtgcacttccagttaaaattggcgggtctactttcacgaagccttcttgatggaagaattcatatgtagcacgaatgatttcattacgaattttcataatagcatgctgctttttagaacgaagccataaatgacggtgatccattaaaaattctgttccatgctcttttggtgtaatcgggtagtcagttgcttcgtgaatcacttcaatggatttcacttgcaattcaaaaccaagaggtgaacgctcgtcttttgttacttgtcctgtcacatagacagatgtttcttgagtaactgatttcgcaagcttaaagacttcctcttccacttctgcttttactacgactccttgaataaagcctgtcccgtcacgcagctgcaagaatgcaattttaccgcttgaacgtttattggcaatccatgcgccgatggttacatcttcatcgacatgtttgaacacttgattaatcgttgttttcaacataattccctccaaagccagaaagaagctcaccttttcgataggtgtgattcttttttcatacattttattataaccgttctaaatcagcatggtcaacgcaagacaggagaaactacggcgttacatttttttccacgtgtcctgtcgagaaatcgacatagctaaagctgtattgattgttttcatttaagtacgtcacttcccaaaggagtacgtcaccttctcttgctaattgaacgtcctttagcttagagaccgtgttctccttttgaacggcttgtactgcttgatttgaggtaatgccttctttttctttttttgcgatcactttttcttttttgctggcaggtacccaaacataggttgtttcgttttgtttgtttttcccttcaacaataaattgtttttcttttccaacaaaagtttctacttgctccacttgtacgatgtttgcttgtttttttgctcgttcaatcgccgcctcatgaccttgttctttttgtcccatggcaatctgataaatccacgtaaagctgatgataccaatgagcaaaacgagtgccacaatggatgagatgatccagactatttttttcatgtcaagcttcccctatgtgcgatatattgtaaatatcgcttgattttgatcttcttgatctaatgccaatccaaacatgagatcttctcttttaagcgttctgttcaataagtcaacaattttatacaggtcttctgaatgcttaatgtgaacagttgaaagtacctctattttactttccacttctaattcctcctcggtacgtaaatattgttagtcatacttttcggcacgggaaccgatactatttttacaacggaacacaaaaagccgttacgataaattaactccaaacccacaccagctaaaggccgcttatgacagcggcttttcgtttttgagtttctctatatacgcctcaagtgattcttttgacatctcgtggactggcgcatgagggagtgattctaaaaatagctttccatatgacgcggttttcactcggcggtctaaaatgagcaatgtccctatgtctttttcagagcgcagcaagcgtcctgcaccttgtttaaaggttaacacagcttctgggagagcaacggctttaaacgggttcttcccctgttttttagcggcatcacattttgcttcaatgagcggtgaatcaggcggccgaaacggaagacgtgccataataactgttgtcagctctgatccaggaaaatcgacaccttcccaaaaactacccgtaccaagtaaaattgcatgttttgctaatttgaacatcttcgttaatttaacaggactaccgcccgtcagaccttgggcaaaaagggcggcttgcatcccttctgttttcagttcatcatacactgcttttaacatctcatgtgaattaaacaacaccaatattttcgcttgttgctgcttttccattatcttaatgtaccgtactgcttgctttacatagtcacgctcatcacggttcgtaatcggcggcatatcagctggtacaatcaccttgagctgtttctcaagttcaaacggtgactcaatctgtacaagatgcggataaaaatcttgcagaccaaatcgttctaagcaataatcaaaacgaccattaattgtgagtgtccctgatgtgaggacaacactttttttgttcataaaaaatcgatccgctaaaagctcgccggtatctagcggctgtgcatgcataaagacagcatttttggcaccctttgcatcgatctcaatccaaaccgtttcatcgtttttcggttcaaaaatgaaccggtacagcgtactgcaaaatgtatgcataaacgacatcacttgatcgtattcctctgcttcaaacgcaaagtgttctgtcagctgatcacttttttgaagaagctcgcttttttgctgttcatacagcttttcacaagcaattaacaaggaacaaagcttacttgccgtctctttaatccgtttccactgcgcatgcttcgactgatgacgtactctatgaatgagacgattgatgtctgcttttggttttgtccttttcacaaaagaatgaacggtactaaagaaggcgtcactttccatttgaagctgctgaagatactcatccatttcgataaaggtgtccgtctgtaagtcggcaccgtgaaatctctttttcagcttctttaacagaccgccctgtaatgagccaagctgtgttaatttcgcatgaagctggatatacgacgcactatcccctagcgtttcattggctgttttctcaaattggtgagcctcgtcaatcacatatacgtctgcatgctgaaagatagatgatgcttccgtttgtgataagagcaggcgatgattcgttaaaattaaatcagctgttttcgcccttctttttgcacgctcataaaagcaatattccttaaagcggcgctttttcgatgtaaacggcatgtgcacacacgaaatccggtcttttatattggcagctcctgaaggtaaatttagttcagataaatcacccgtttctgtcacaaggagccacattaatatttgcgccttcgttaagaccacatcatagttatcatcttcctcatgcagcacatgctcaaacttatctaagcaaatataatgcgcccgacctttgaatacacaggctgctggctcaaatggaagcaattgatttaaaatcggcacatcacgctgaagcatttgctgctgcaaaagaatggaatatgtactaataatgacaggttttcctgatttttttgcttctaatgcggctggtatgaggtatgcaagcgtttttccaatacctggtgccgcttcaattaaagcataagctctttcatgaaacacatctcttactttattcatcatcttgagctggccttctcttacttcatagccttccaccgtttggggaagcttctttttgatctcctcaaacagctgttcatcgtcttcccctactgaatctgtcgtatccttttcagaattggtgacatctttaacagcaaaagagcctacttctaccaaagaatcttcacggctggcatcactcatttcaagctgctggattaaaaatccaatatcacttaagagataagaggataatctgcgcagctgcttaagtacatttggcggtgtatgtgtcaattgatgaagtaaggttaaaaataacatggcagtaacttccgcatcactatccgccctgtgcgggtggtcatgtggaagcatgagctcttcacttaattcagtgagcttatagccttcaagctctggataaagaattctagaaatttcaactgtatcaatcgctagcacatccagctcatttttcccgcatgcttttagttcatcatttaaaaagttcaagtcaaaatgaacattgtgcgcaacaaaataagcgccttgaatgagatcatacacctcttgggcaatgtcctcaaaaaacactgcatcgtctaccatatgctgctgaatgcctgtcagctgttcaataaatccagggatcgtttttcccgggttcacatattttgaataccgttcgacaatttgtccattttcaatgaccaccgcagcaatttgaatgattttatcacccttcttaggtgaatttccggtggtttcaatatcaacgacaacaaacctttgatcggccataaaatggacacctcaattcctcgttccactcaaagtgaaacacgctctgggcaaaaatagctgaaacagaacagcttctttgcttaaactgttctgtttcattggagcatgcgttataaaatcgttctcgcagactcttgcccaatcatttgttcaatttgattttctttatttaacacgaccacttttggtgtatgtgtctttgcttcttcttctgaaagcatcccataagcgataataatcacttcatcccccggctgaaccaatcttgctgctgcgccatttagacaaatgacaccgctctttctttgaccgggaataatatatgtttcaagtctcgcgccattatgattattgacaatctgtactttctcatttgccatcatacctgccgcatcaagtaaatcttcgtcaatggtgatgcttcctacataatgtaagtttgcttctgttactgtcgctttatgaagtttagaagtcataaaggttctatacatgcttttcaccgctttcaggaacatggaatatcacattatcaatcagtcttgcccgtgagaatttcaccgcaatcgcaatgatgacctgacctgctaactgctgaagcggctcaagctctggataagagtaaatctcaatataatcaatttccccgctagtttgaagaatttcctcttctaccaactgataaatgcgactgacgtcacgttcacctttttcaaccgctgactgtccttttttcaatgcgcggtacaaagcaggagcttcttgtctttctttatcagacaagtacacatttcttgaacttttcgctaaaccgtcttcttccctaactgtcggcactgagacgaggtgaagatcaaagaagaaatccttgatcatcgcatcgatcacagcgacttgctgtgcatcctttagaccaaagtatacatttgttggtgctacaagatgaaatagctttgtaagcacagtaacaacaccgttgaaatgtcctggacgttttttcccgcataagacatcagttcgcttttgaaccgtcatcgtgatcgatggttcatttggatacatttctttcacatcaggtgtaaataaaatatctacccctgcttcttctgcaaggcgctgatctctttccatatcccttggataggattcaaagtcttcgttcggtccaaattgcaaaggattgacaaaaatactcattaccacaatgtcattttgatcccttgcttctttcgcaagcgtcagatgtccttcatgaagaaagcccatcgttgggacaaagccgatggaatgctgtttttcttgatgcaacttgatcaattccttcaactcgtgaatatgggtgacaacgttcattttttgatacccccatataaaccatcaaggacttcttctttgatatgaaatgtatgcttgtcttctggaaatgtgtgtgcttttacttcttttgtatattgaataagcgcttcttctaatacagtatcaatttgcgcgtattgtttcacaaacttaggtgttctagacacgccgtatcctaccacatcatggtaaacgagaacttgtccgtctgcctcagcccctgcaccaatcccgatcacaggaatcttcagcatgtcggtaattcgttttgtcagttcaccaggtacgcattcaagcacaagtgcaatcgcacccgcttcctcacattttaagctgtcttctatcaatttctgcgcactttcgtggtcttttccttgcactttatacccgccaagtactccaactgactgaggtgtgaggcctaaatgactgacgacaggaattccgcctcttgtaagggcttgaatggattcaaatactccatctccaccttctagctttaaggcatccgcaccgctttcttgcatgatgcgtgctgcgtttttcaatgtttctgctaatgaataatggtaagacataaatggcatatccgtcacaataaatgtgtcttttgcgcctcttttcactgcttttgtgtgatgaatcatgtcatcgatcgtgacttgtactgtcgaatctaatccaagtacaaccatcccaagtgaatcaccgactaaaatcatgtcgacttccgctttttctgcttgctttgcagatggatagtcgtatgctgtcagcattacaattggttcattttgttctttcattttgaaaaaatctagctttgtcttcatttgttcctcctcattctggagaggagatggcttgcctcacatcacatgttttgatctctcatgcgcggcgaatcatccctctgtccaagtcccttaggatcaaggcagaaattcatcaaatttttgtttctaacaggtgcagctcttttcagatactgcccacacgaagtatatcaaaaatgtgccgggtgttccacttaagttgacttgatctcgatgtctgcggagtagattttttggatcccttcctccgtttcaagcaataaaacaccttcttcattgattccgagcgcttttccagtgtattgcccattgacggtacgggccacaatatgctgaccgatcgtcatcgcaaacgattcccacaattgtttaatgggcgcaaatccatggttcatataatcagcataccttttttcaaatgtgaacatgatctgttggatgagcgcagcacggtccactttttcattcagttccattcgcatgctcgtagcgacatcctctagttcatccggaaagtcatctgccgtttgattcacattaatgcccggtccaataatcacagcatgaacctgatccgcctctgcttttaattcagtcaaaataccaacgacttttttcccgtttagcaaaatatcatttggccatttaatagaggggctgagtcctgtttgctctgcaatagcttctgcgatggctacagatgccaaaagcgtcatctgcggcgctttgtgcagcggaatttcagggcgtagaatgagactcatccaaatgcctgtcccatttggtgaatgccacgttctttgaaggcggcctttcccgtttgtctgatgatcactgacaacgagcgtgccgtggggcgcaccttcatttacaagatcatgggcaatcagctgtgtggaggcgacttctttctgaaaataaatgtgtctgccaaagcactctgtgtcgagaccaaacaaaatttcgtcctcactaattttgtctggtttacgtagcagacgatatccttttcttctgacggcttctacctcatagccttcttttctgaggtcctctatatgcttccagacagccgttcgagaacagccaagctcatcacatatttgctgacttgaaacaaagtcctgactagatgctgtaaatagttcgattaatcgttttctaattgctgatcgcatgctgtaagccactcctctatggcttcttttcggttttccaaatgattgtgcagaacggcatttttcaccaaattaagctcttctgcgatccattttcctgatgtcttttgccgaaaggccattaaatctttacctgaaacagcgaggtcttgaagcgttttaatcggcagtgcatcataagaacgcttcgcagcctccagctcgtcaaagaaaatgcggcgctcgtgttttagctgtgtgatcttcaagctagataagagcacgtgttcaccagcctcgaacatcttctccgcatcccagtcacaatcgacgtatcggctaatggccaccgcgtcttttaatagctttgttgacagcttccattcttttaaaaagagcacagcctcctcttcatctaagccaaacaaatggataacagctccccatacttcttccagtccatccagtaaataatacggaaatgactgaaaagattcttgtagacgatcctttttgagacccggcaattcttcatacaatttggtagaaatgagcactttgatcgcccgctcacaataacgtccttttaaaagcttttccatttcaatctttttgcgttcaacggatatgttggcaaggagatgcttatctttttccattgcctcagccgtttctgcagcgagctcaaaaccaagctggcttaaaaaacggaccgctctcatcatccgaagcgcatcttcttgaaagcggcacgcaggatctcctacggtttgaattcgtttccgctcaatatcctgtttgccccctacatggtcaatgatctccccatttatatccatggccatcgcattgatcgttaaatctcttcttaaaagatcttccttcaaggatgtgataaacgccacttctttcggtctgcgaaaatcttcatattctgattcagttcgaaacgttgtcacctcatagctaatcccatcatgtaacacaatgacagtgccatgctctttgccaacatcaactgttttttcaaataaagactcgaccgtatcaggcgttgcatccgttgctatatcgatatcgccgatttccctgcctaaaaggacatctctcactgctccgccgacaaagtaagcctgatgcccatgttcgtgcagtgtatgtaaaatagggatcgcatgtgtgaatggttcattcatgttcatcatcaccttcgatcaattctaggtaaagctcttcatattcactcacaattttttcagaagagaaatgggtttgaacgctagactgggctgccgccgacacttgctcatgaagcgctttgtctttcagtatagagactgcgtgtttagctgccgcttctatatcgccgagcgggacaaggaaacctgtttccccatgtgtaatgacttctggaatcccgccaacatcagtcccaatacacgggacaccgcatgccattgcctcaagaagcacaagtccgaagctctctttctcagataaaagcagcttcaaatcactgatggaatacagctcttctactttctcttgcttccctaaaaataacacgcggtctgtcagccctagctttttcacgagttcgcaaacaaccgatttttctggaccgtccccaatgagcagcagttttgcattcacctgttcagagatttttttaaacacatgaatgacatcatgcactcgcttcaccttgcggaaattcgatacatggatgacgaccttttcatcatgtaaaagaccatagtgtctcttcagcacatcgtgatcttcacgcaagtatacacgctcatcgacgaaattatggattgtttcgatctttttatttggtttgatgaggtcgtacgtctgcgcagctaatgaatgcgacaccgccgttacccggtctgatgattcgatcgcaaagcgaatgacttcctttagtgatggatcatagcctaataccgtaatatccgtcccatgaagcgtcgtgacgacttttacagagtgtcctatcatttgcttcgctaagtacgcacagacggcgtgaggcaccgcatagtgcgcgtgaataatatcaagcttctctcgtcttgcgacttctgccaatttacttgctaatgcaaggtcataaggcggatattggaaaacagcgtattgattgacatccacctcatgaaaataaatattcggatacactttattgagcctaaacggaatacttgaggtaatgaaatgaacatcgtgccctttttcagctaaacgttttccaagttccgtcgcaataatgccagagccgccgacacttggataacaagtgattccgaccttcagttttttcataattaccccccaagtaagtcgtcatcgatcaaaagtggtttttttgtgataaacccttctgcataagctttattgacttctcttccatacatagactctctcattttgacaaaatcaatatacccgttcacaagaggtgtctcaactgaattcgccgatttcacaaattggctttgatacgcatgcaggctatcaatcttttggtgcatttcctcagaaatatcaatcacaaaatctggacgatgatggccgttaatcatgtaataatacatttgacttattttatgcgctgactgcttgtatgaatcttcaaatttatgtatccctgccgaaaaagcagcctcttctacaagtgaacccgcatgaccatgatctggatgccgatcttggtgatgcggagcaaaaattagtttcggtttgtatgtacgaatcacgcctgcaatgtccttcattgcttcgtcatttaaataaagccctctgtctggcagtgtaagctggattcgcgttgacacgcctaaaatggcggcagccgctttcgcttcctctttacggctctctactgttccattcgaggataattcagcctgggtcaagtcgcaaatcccgacacgtgcccctttttttacgtattttgcaatcgttccgcccataccgatctctacatcatcgctatgggctccgaatgcaaggatatcaagtcgtttcatttgttcctccgttttttgctacatctcgaaaatcaaacgtacctttatttaaattcctgactaaaatttcagccgtccccatattggtggcaagtggaatggtatacacatcgcaaagccgaatgagtgcagatacatctggttcatgcggctgcgcggtaagcgggtctctaaaaaagagcacaaggtccattgcattatcagcaattaaagcaccaatctgctgatctcccccaagtggtcctgactgaaaacgatgaatgggaagccccgtcgcttctttcactctcaaacctgttgtccctgttgcgtaaagtgtatgatttgccaatatatcacggtacgcaatagcaaattggatcatgtcactttttttcttatcgtgagcgattaaagcaatgttcatcaggaatccactccttattagtcgatgatattttctaaaccatagacgagctgatcaatgtgcatgacttgttcaactgaaagctttacacctgacataaacgaggcacggttataagaatcatgacgaatggtaagcgtctgtccgtccattccaaacagtacttcttgatgtgcgatcatacccggaagtcttacgctgtgcagacggataccgtcataatctgcacctcgtgcaccttcgattaattctttctcttctggatgtccttgctttttgctttccctgacttctgcaatcatttcagctgttttaagcccagtaccgctcggggcatctagttttttatcatggtgaagctcaatgatttcaacgtcaggaaaataattcgctgccattttggcaaacttcatcattaagaccgcaccgacagcaaagtttggcgcaataatgcagcctatgcccttttcttctgttaattgctggagctctttcaggtcagcttcagaaaatccagtggtcccgacgactggacgcacgccatgttcaagtgcctttttagtatgtactttcccaatttctggtgtcgtcaaatcaattaatacatcaggtgctgtctctgaaagacacacatcaatatctgtataaattggcgcctcagatgtcgtatgaatcacatcagataatttttttccttcgtgcgcgtgatcaagggctgccacaagctcaaaatggctcgtttcttctgccagcttcacagcttctatccccattcttcctcttgctccagcgattactactttgatggtttggttcgtcatcgtctctacttcccttcttttttcgtccagcggtctttgtctcttgtattgaatttatgcatcacacgatcatgtgcttcctctagtgatatatctagtgaattagcgagacatgttaatacaaacaaaacatcgccaatttcttcttccatgcttttttccgtttccgttgtttttttcggcttttctccatagtaatggttaacctctcttgctagctcacctaattcttctgttagacgggccatcatagcaagcgggctgaaataaccttctttaaattgtcctatgtaatcatctacttcttgctgcacgtgacgcagcgttttttcattcgtcatgaagctcatcctcctatccatctcttacatgttagcgaaatcataaatatttgacaaatgtttaaaactcagtttgcttgtttctctcccataccatataatattatcgctgtctaagcaaaaaaaggagtggtctcttgctaaaagaaattcgtcttaaaaatatcgtatttattttaataggatctgcgattttttctttcggtcttgttcattttaatatgcagaacaatttggcggaaggcggatttacaggtattacactgcttttatattttctattccacattgacccatccatttcaaaccttgtcttaaacattccgatcttttttatcggctggaaaatgctcggcagaaccatgtttacttatacaattgtaggaaccgtcagtctttctgtctttcttgccattttccagcgctttcaaatacatatgcctctccagcacgatttggccctagccgcgctctttgctggcgtgtttatcggaacaggcctcgggatcatctttaagttcggcggtactaccggcggtgttgacatcatcgcaagactcatcaacaagcattatcaggtggctatgggacgaacaatgttcatcttcgacgcttgcgtcattacgatttctcttacttatttaaattacaaagaagccatgtatacactcgtcgcagtatttgttgctgcgaaggtcattgacttcatgcaagaaggcgcttacgcagccaaaggcgccatgatcatatctgaaaaagatgacatcattcaaaagaaaatcacagaggaaatggagcggggtgtcaccattttaaaaggggtcggttcctatacaaaacaggagcgcaacgttctttattgcgtcgtcccgaaaaacgagcttgtccatcttaaaagcgtcgtgacctcagtcgatcctcatgcgtttgtatccgtcagtgacgtgcatgatgtgcttggtgaaggcttcacattagatgaacacaaaaagccgctcaatccgcattaaaaaaagaagcccaaaaatggtgcttcttttttatgatttcggataatcagcttgtcgcttttgcttcttctctttttcagcacggtatttcctaaatccaacatacgttaatgttaataaaatgatacttcccgttgttaaaatgacccataaaagcgatgggtcagcctcatcttgatcaacgtgggcaaatacactcgataaatcctcttcaagcttcgtaaggcgctcaagctttgtcccacttgatgcttttaaaaattcaccttgctcaatcacttccatatgctgcttaatcgtttgcagcttttcaggagaaacatcaatggttaaactcggatagatcatatcgtataaagaaaccagctcattccaagtttcataaaacgtcgtcgactccggatccttcacttcttttttcaacgtaggaaaagaccccataatgggcttctccagcgaaccccaaagcggctcagaatctgactggatcgcatcgagcagcattctaaactgagaggcataacgaagcttttcgcgctcattcaattcttcctgcggcagcccttttatgatatcttgatagccaactgtaatttgccgaatctgagtatttgtcagcgttccgcgccaattctcagctttaaatgtcttttcaacatacaatgcgacctgtaacgcctcatcatatttagcttgtctcgttagttgaaagattgaatctgatagttccgttaattcttgcagcacactaacggctgtttcctcgcctttggcaacagatggctgtaatacgagaaaaaataatagaatcatcgcgattggctttcgtttcatgcaagtccctcctagcccttctccatacagcgtatgaagaaaaggacaaggttagaccaatattgttaagggagttcaagcttgatcgattttttcgataggacgagataatatgaaacaagaagaacggcaatgctcaaccaaaacgtgacgtagccgatctcgtttgtataggcagacagcatagaataacgcggcatcataccaaatacataatcaatcacatcattatgtaaaatccatatgccagctaccaccaaatgacgcattttaaaacgatagtacggtgcaaacaatacggcttgaaccgccatcgcaaagtgggacccaatcagcatgtacccttcccacggaaagtcatccacagataaaaggacaaagatattcattcctacagcccataacccgtacttaattaaggtcacgagggcaagtgcttcaaaataaggagcgtttcgtttcatcaaaaacgcaagtagaacaaataaaaagaaaaagcttgccgttggactgtctggaacaaaagctaaaaagatagccggcgtctctacaagctgtggaatataccaatagtagccgtacacagtgccaaggaaattgatcatcaagactaacacaagcatgtagcgcgtggctagcagatattgaatccatctcatatgtctcttcactcacgatctattaaaatcagaaaaaagctgacagcgccagctttttctcttttgagtatatccttgtacttgcatttaaacaactgaattatttagatttgacctcagataaatatttagacagcttttcaagttcttcatcgctgcctttaaagatacccttaggcatgttaccttttccttcaacagcaatcttagcgatctcctcaggtgcaagaccgttgtcaacaagtgacggtccggctgctccgccctgcatgttatccccatgacaggagatacatgtctgctcctgataaattttatactcttccgctgaggtatcaatttctgcttctttcttaatttcaccttgctttgccgctgcttcccaatcatgagtagcaacagactcccacgttaaatatgttgctgcgccgactgcaaggatcatcatccccactgcaaccggtcttctatacggtctgcgttcaggaccagaatcaagaaatggtgcgagcaacagtgcaccaaacgcaatcccaggcataatcatcgcaccaactaccgtatagccgcctgcagcaaattcatattttaataactggtacaagaataagaaataccagtctggcagcggaatatagccggtatctgttggatcagccatccgctcaagcggaggtgcatgaaccacagttaggacaagaaatccaattaaaaaaacggcacctacaagccattcctttaaaagaaagttcggccaaaaggcttctgtttttcccggatattcggaatagtctttaggtatgttaggttttctttctgccggaattctagagtctccgacaaacttcatcccttttcccctatgcaaagtcatcccctcctcattgaacattcatcaaacgcaactttttatagcggtccagaaattccttgcttacgaatcataataaagtgggcagccatcagcccaaataatgccgctggcaagaaaaagacatggatagcgaaaaatctcgtcagcgtttgtgcccctacaatgtcaggatgacctgcaagcagcgttttgatctctttaccaatgaaaggtgtcgcttctgcaatttgaagaccaaccttcgtcgcaaatagcgccttcatatcccatggcaagagataacctgtaaaaccaagtccaagcatcacaaagaaaatgagcacaccaacaatccagttgagctctctaggctttttatacgccccttggaaaaagacccttagcgtatgtaaaaacatcatgacaataactaaactcgcaccccagtggtgcatccctctgacaatctgaccaaatgccacttcattttgtaaataatagacagattcccaggcgtttttaatatctggcacgtaatacatcgttaaaaacatgcccgaaaggacttgaatgactgtcacaaaaaacgttaaaccgccaaaacagtacacaaaagcggagaaatgatgtgctggattgacatgctctggcacctcatgatccgcaatatctctccatattggtgtaatgtctagccgctcatctacccaatcataaatcttgttaagcatcgttacccttcccctttcggcacagcttttccaagatagaggtatccgtccttcacttgctgcttataatggtcaagcggtgcaagtggcggagttccgggtacgtttgtaccatccttgtcgtacagcccatagtggcatgggcagaaaaatttgtttggatttttcggatcactgttccagttcactgtacatcctaaatgtttacagattggcgataaagcgacaatttcatccccttctttgtacacccatgctgacctagattcctttgactcataccatgcatctacttgatcaattttaaagtcaaagcgcttcggttccttcgtcagttcatctacactgacaacttgaaccatatcctgatcctctgttccttttagcacagggtcaagcgcaaagcgaaccataggcatgagcattccagcggccataaatccccccacgccggtcaacgtgtaattcaaaaattgacgcctggacactccatgtctcttctcgctcatttttttctccccccctcaggtcgtcagctactttataactgaattagaaaaaatttcataaaactaggacaccctcataatatatcaatctattcacaaggtcaacagcctaaaaagctatgtacaatgcaaatgtaagggtttttatgaagggttccacttttgtaacaaaaagttcaaaatttgttctacactgtcttgtacaattttttgctttaattctacctttaaatgctcgagcggaaccggctttaacaaaaatagtgattcactaaccgccgcatgctctttccattggtgatcagatgagattaacacgacatgctgaaaatgatcttctagcgaccgcttcatcgtgaagatgtcttctagttttcgttcattgatttctacatatgtatgtggtggaaaaagaaagacccgccctttcagctgcctttcaagttcctctgctacaagaatggtaaactcccctaaagatacggtttgtttgatttgattcgcatctattccaactaatggaatgatagcggtatcaatgtaatctttagattgcaaaaagcgatccgcatcctccgcttgaaacttcatcaatttcccctctttcatgacataagccctgcctggatagggcaaggcttattcgttcagtttatgacaataggcttaattctcttgctaacttattaaatgtttcttgatcatgacggtcaagtgcttcatctatctctttcataagccgttctttttggaaagttgcgatcgagtgttcaagcactttctccgcaagatccttatccttttcgttctcataaagatcctttggaatatgaggatttgtttcaagcacagctgcatattccggagaacgataagcagaacggaaattcaattgaataaacaaatcttgctgtttattcaaacgaatatcatgaaatgacttttcagcatctgtcgtcatgatgttttctttataaaatctaaagggaacttcatccacacagtgtgttgacataatgattccccttgggcaaaattctgcttgctctacaaaatgaaccttttccatcaaagagtcgtgactcattaaataatttaatatccaaacacactctcttcgctttaactgataatggtttaaaaaccaccggatgaattccttcttttcattgacagaaacaggggtctgcatgttattccctcctctatcgtaaattaaattgctatacatgaattattcaacaaaccagttcttcattcctgcaaactataaggaaatttcgtcttcaattcttaaaatcgtttcttcgatttcttcattcgtgccatctttctgaagaactttgcgtaatagcggcaatgcttctttttgtctgccttcttctaaaaggaacgatgcgtattcatataaaaagtcacgttcctcatcaaaatcaggcagagccagcttgaagtactcagctgcttctttatattcctctcgtccaacagatgctgatgcagcataccaattccattttggatcatcttccccaaagcttttaacctctttaatgacatccaaaatttcatcaaaaagctcttcattcaaatagatcgcgagcaatgtttgaatcgcttcaatatatcccggatcaagagcaagtgcttcttgaagcagctttttcgcatcttctgaatccccatttttcaagtcaatctttgcaccatataaatataattctttgttatactcatcaattttaataccctcttttactacctctaaagcctcgtgatatagtccttcttcctcataacttttcgctaaaggcatatatagagacgaataagatggatcaatatcttttagttctgaaagctgctgaatggctgttttcgttcggccagccctcatcgctgtaaatccgtagccaaaaagtgtattcggatctgtttgacctttcactgccttttcgtaccattcaagcgcatcttcaaattctccagctgtgctgagtgattcagcaagcctctgataaacattgacgccgccaacctcatgttgttgatctgcaaccttgtagaaatagtcggccgctttctttgaaagaccttgtgaaaaatacaattcacctaatgcaaaatcaataatggcttcatttgggagcagctcttttgcttttaagagcttttgttcactgacttcaaatagtccttgcatttgatacaaatctgccattaacagtagactctctggatacgcatcatcatcttcaggaatcgtctctaataccgaaatcgccttttcttcttcatcagagtcaatcaaaagttctgcataaaaacatgttaaccctgtttcctctggatataaatcatgtaaatcactgatgagatttctcgctttatcgatatctccccaatcataatataactgagctgcctgcgccttttcttcatcatgcaaatgcttttctgccttagcaagtgtttgaagtcctttttcagtctcacccgcctcaactaattttatggcttcttgtaatgaactattcaaatcaaaccgttcctttctgttttccaaaaacctaaactattgttacttcatatcataatcgacaggtactcatccagcaaatatgttgcacttttaaaatgaacccatttttgtgttttaaagactgtttttcatttcatcctttacgaaacggaagttttgtaaactaaaaacacctgaaattcattttttgatcaaataaaatgaattttttccaggtttcatcttgagacaagctatgctatattccttacaaatatgcctaaggaaagaaaaagcctgaggacatcctcagactgtttttgttaagtattcaatatgttcaaagaaattcgggtatgaaacgcgtacagcatctgtatcttcaatctcaaccgcttgctttgtgatacatgcagcaatcccaagcatcatcccgattcggtgatctccgtagcttgacacgactgcgccgccttgaagcgtggttttaccatgaatcttcataccatcatctgttgcttcaatatcagcaccgagttttttaagttctgacacgactgtatcaattcgattggtctcttttacttttaactcagcagcatctttaatgatcgttgttccttctgcttgtgtcgctagaagcgctataattggaatctcgtcgataagtcttgaaatcacatcaccagaaatttcaatcccttttaatgaagaggtcgagatcgttaaatcaccatgtggttctccaccttttgcatctacttcattgatctcaagattcgcacccatttgtttcagaacatcaataatgcccgttcttgttttgtttagcccgacattttttaacacaattcggctgttaggaacaatcgatccagcaacaaggaaaaatgcagctgaggagatgtctccaggaacaaatatatctgttgcttttaatgcttgaccgccttcaatggaaacactttgttcatcttcatctagtttcacaccaaacatagagagcattctttctgtatgatctcttgatttatgtggttcagttaaagtcgttgttccctctgcttgaagccctgctaaaaggacagcggacttaatttgcgcacttgccaccggagactcatatgagataccttttaaatggccgccacgaatagacagtggcgtatactcgccgtttgctctgccatctattttcgctcctagttgtttaagtggacctgttactcgcttcattggtcttttagcaatactctcatcaccgatcagtgtactgtgaaactcgcaaccagctaatattcccatcattaatcgaatggttgtaccagaattaccgacatcgaggacgtcagacggctccttgagctctttcagtccctttccatggatcacaacatcggtccctttttgttcaatttcaacgcccatctttctaaaacaatcaatcgtacttaaacaatcggctccagggagaaagtttttcaccactgtcgtcccatcagcaattgctccaaacatcactgatcgatgagaaatggatttatcacctggaatatgaatgactccattcataggagcatgtttatgaattttcatctttgtcacctcagtcagcataaaatgtatcgtaattcgctctattttttatacagatctctgcacgtttacggtcgttttctgtttgaaaactaatgcgtaaaatcccattaatgtcttcccgcgtttcaataatacggatattcgtaatactaatgttctcatttgctaaatgccctgtaatctccgaaatgaccccagggtgatctggtacatccacataaaggtcataaaaagctggaatggcaccttttttcctcagaggaagtccatcacgatattcctttgcctcttgaaaataagagaacaagccttcagcgtcttcttgctgtacaaaggtctcaatgcggtcgatctcttttttccattcatggaaccggtctaaaatcttgtttttgttgtgcagaaggatatctcgccacattgcagggttgcttgacgcaatacgtgtaatgtcacgaaagcctccagcagcaaaccgtttgacgagtgggaattgttcttcaaaatgatgtgcttgatgcacaaggctggctgcaacaatatgagggaaatgactaatcacacttgttacaccatcatgttcttctggggtcatctcaataaaatgagcatttgtcccctttaacaagtccttcaaacgatcaacagcctctcggtttgtttcctttgccggcgttaaaatgtagaacgcattttcaaataaaaagtctttcgctgctatgacacctgacttgtgagagcctgccattggatgtccaccaataaattgatagtgcttaggaagcgttttttctgcaaaatggacgaccttttgctttgtgctaccgacatctgtgattgtgagctctctctcaattccagagtttgcaatatcacgaagcatcttgactgtttgctgaacgggtgttgccaaaataatagtcgcagattcagccaaacctgccgcaaatgaatcagctgctaaatcaatgatacccagctttgttgctgcaaccacctgttctttggacacatcatatccaacaatttttttatgaggatactcttttttaatcgacagtgcgatggaacctccaattaaaccaagtccagcgattaatattgtttcatttgcatcattcatgttcatcacctgttttttcgtgaaaattaaaaaagccatttcaacagcttatatgtatgaagttggtacaatgaaagccatatcctgtaaaaggatatgactttatggttatgctacgcacgaatgccttgcaataaatcagcaagtgtacttagaatttctgcattttgctccattgtcccgaccgtaatacgtaaagacgttggaaaaccaagtgctttaccagacctaacaatgtagccttttttcaataatgcattgaataattcatctgcatctcttttaaaatcaatcagaacgaagtttgtttgagacggataaataaatagtccaaaacgttcagcaaattcttgatattgcttgagccctgcttcatttttttgtctgcatgattgaatgaagtcctgatcttttatcgctgcacgagctgctgcctgagcaatacgactcgtattaaacggctctctcgctggttcaatcgcagtaatcaactcttctgatgcaatgccatagcctacacgaagcgcggccagtccatacgctttagaaaacgtacggagtacgatgacattttgatagttgtgtaataaagataagctattcggaaagtcttccgcacgaacgtattcgacatatgcttcatctagtactacaagcacatgagctggtacttgatctaaaaacgtcacaagttcagattctgacaaatgatttccagtcgggttattcgggttacatacccagacaaccttcgtgttctcatcaatcgcatcaagcatgccctttagatcgtgagctcctccgtctaaaagcggcacttctcgaatctctgcccgctcaatgattgcattgtgacgatattgcggaaaagacggagctgggatgacggtatttgtatgttggtcaaggaatgccctagcaataatttgcacaagttcatctgagccattcccgaatattaattgtttttcatttacttgaagaaactcagcaagctctgtccttaaacttgcgctgtatccatctggataaatcgctaaatgttcgagttcagcttgtatcgcctctcttgcatgcgtggaacatccaaaagggttttcatttgaagccaatttcacaattttgtctaattgatattcttttttgacctcttcaattggtttcccaggttgatacggttttagttgttttaattgatctttgatttgcaaaagtttcacctcatttgaatgaatagaggggactaaatgtttttgcataggtttcaaattctcttaaagcgtcttgacgtgtatcatttgctaacaattgatcttgaagttcttcaatttttttcacaagtgcactgcctaccacgacgccgtcactcagtttattcattgagtctacctgctctcttgttgagataccaaaaccgaccgcaaccggtatgtgactcagctgtttcacttgttgaataaaatcagtaatcgattcgtcaaaggtttgtctgacacctgttacaccaagagatgaaacacaatacacaaaaccttctgcctgctctacaatatttactaatcgttccttactggttggtgcaacgagcgaaatatatgaaatgtcatatgtttgacagttcttttgcagctcactgctttcttcaaaaggcaagtcgggtgttaagagtcccgaaatatgatttttgcgcagtaaagcgaaaaagtattctgtgtctaattgtaacacaggattataatacgtaaatagaattacaggaatttttacaccgttttttttcatcttccctgctaattctatcgcttttacgatattcatgccatgatttagagctcttttggaggctctttgaatgacaggaccgtctgctagcggatcggagtaaggaacacctagctcaatcgcatgtgcaccggctgcttgaagggacaaagctaaatcgatcgtgatttcttctgacggatctcctgccgtaataaatgggatgaataatttctcgccttgctctaattgaaatgtgatcatttggttttgccctcactttcaagcacattcattaatgtatgcacatccttatctcctcttcctgacaggcagacaaggatgatttcatcttcactcatcgtcctgctcatctcaaatgccttggctaaagcgtgtgctgattcaatcgctggcagaattccttccttttctgtcagcagctttagtgcatccagtgcttcttgatctgtagcacttacatattgaacgcgtccgctcgcatgtaaataagcgtgctctggtccgattccgggataatctaaaccagctgaaatggaatagggctcaataatttggccaaattcgtcttggattaaataggtcaaagatccatgaatgactccttttgtcccctttgtaatggttgctgcatgaagcggggtatcgaccccttttccagccgcttctacaccaatcaaatcaatctcatcatccaaaaacgctcggtacattccaatcgcattacttccgccgccgacacaagcaatgactttatgtggaagcctgccttcttttttaagcatctgctctttggcttcatcaccaatcatccgctggaactcactgacgatttggggatacgggtgaggtcctacaactgaacctatcatatagaaatgatcactacagtgctggacccaataacgaatcgcttcgttcgttgcatcttttaatgtgccgtttccacttgtgacaggtatgacttcagcgccaaggagcttcattcggaatacattgagagattgtctctccacatcctcttttcccataaacaccgtgcacgataatccaaactttgcggccaccgttgcagctgctactccgtgctgtccagcgcctgtttccgcgatgatgtttgatttccccattttttttgcaagcagtgcctgaccaagtgcattgttgattttatgagcacctgtatggtttaaatcttctctttttaaatagatttttgcgccgccgaggaatgcagataattgatcagcatgtgtcagcgcagtcggtctgcctgagtagttttgcaatagagaaagatattcttgcttaaaagcggggtcttcttttaattcgttaaatgcttgttctatttctttgagtggctgcatgagtgtctcgggaacaaatttccctccaaattctccatatctgccaagctcatttggatatgcgtacatcgtttaacatcctttcttcgagcgctttgatcttagcgctgcttttcttcccgttttcttctataccgcttgaaagatcgatcgcttttgggccataggcaagcagctctggcagcgtttcaggtgttatcccgcctgcaatgatgcatgttttccccagtcgttttgcttgctgattgtatacaggtaccgcttcccaagcaaaagctgtgccagaaccgcctctcatcccttttactttcgcatcaatgagaaagccatggacaaacggcgcaaatgccgtcatttgatcaagtgtttcttttatattgggatcgtgatgaaagactttccacactaccgcccctgtttgttgttttatttgttttgcatcctctcgtgtttcatctccatgcagctgcacgatatctaaaggaatatgtttagtgatgtcacacactttttggattttttcatttacaaagacaccagtaatctctttctcgcactgcgactttatgagccattgtttcacttgatctggatcgacttgtcttttacttggagcaaaaataaatccgatcgcatctgcttgagattgggcaatgcattctacatcttctagtgagaccgccccgcaatattttaaaaaaggtttcatcgtgtcattctccaaataacgtctgaacggctttttcttgtgagggttctctcattaatgattcacctacaaggacagcactcgctccatgttttttgacaaaggttagatcatcaaatgtctgaataccgctttcacttactaataagacatcctttggtacaagtggtgcaatctcttttgtttgctcaactgttgttttaaatgtctttaaatttcggttattcacgccaatgatttcgggggtgaatatatttaagatatgttccagtgtatcttctgcgtgaacttcgacaaggatatctagtcctttttcctttgcttcagcatagagctcatgcagctgttgcggttcaagtacttctccaattaataaaatggcatctgcaccgatacgtctcgactcttctatttgtattgaatcgatgataaagtcttttcttaaaattggacgtgcgacgtgttctttaatgtaggaaagatactcgtttttcccttgaaaaaatggttcatctgttaagactgataagcagtcagcattcgatttttcgtatgcttttgctgtttgaagaggatcaaaattcggctgaatgattcctttggaaggagatgcctttttcacctcagcaatcaacccaatcgaacggtgaggattcatgagtgcttctttaaatgatcgtctttcatagtgtccatcatgaggtagctgcaacgtttggatatgttcttttttgcgtgcaatgatttcattaagcatagatctcttcctctttcgttttttgttttaaacgagccaattgttctttggctgctccgtttttaatcgtttctaatgcttttaatgttcctgccatgaggctttctgacttgcctgcgacatataaagccgctccggcattcagagctgtaatatgaagcggcgccccttctgtttgatgattcaatatattctgaatcaatttcgcgctctcttccggtgattggacctgaatatctgataagtatcctttttccaatccaaagtcttctgggtttagcgtatattctgtcatggcaccttttttaagttcaatcacatatgaatttgctgtaatcgttaattcatccagcccgtcttccccgcatacaaacaggacatgctctggttctaatggggcaagggcttctgccattaattttgccttttcctttgcatacacaccgatgatttgctttttggcttgcagcgggtggcaaagcggccctaatagattaaataccgtccggaagccaagctgcttgcggactgctgctacttgtttcatagatgagtggtacagtggcgcaaataaaaagcccatgtttttctcttgtatttgttttcttgtttcttctgacgtggattgaatgtgaatcccaagacactctagcacgtcggcacttccgcttttagaagagactgaacgatttccgtgttttgcgattttagcaccagcggcggaagctacaatagcagctgcagttgatatattaaatgtagagagtccatcgcctcctgtgccgcatgtgtcaacgacatcaagcaatttttccgctggttctgctttttgccgcatggccctcacaaagcccgtcatttcttcagcggtttctcctctatgtgctaaaatcgatagacttgcagcgacttcagcatctgttaaagagccgctcatcatatcatgcattagtctatgtgcttcattttctgataggaagcctccgttaacaagagctgatagtcgctgattcatcctgcacactctccttttctgagaaaatatgttcagcaagctgaatggccctcagaagcgctcctgccttgttacatgtctcttcccattcattttctggaacagaatctgcgacaatgccagcgcctgcttgtatggaagcggtctgatctttcacgctcatggtacgaatggtaatacaagagtcgatattaccgtcgaatccaatataggcaatacagccgccatatgtttcccttggctcaggctccatttcatttaataattgcatcgctcttattttcggtgcccctgttaatgtgcctgctggaaatgcggacatgagtgcatcaactgggtgtgtatcctgctttagcttccctgtcactatggagatgatgtgcataacatgtgaaaagttcacaacttttgtaaaggtcggtacggacacgctgccgtattccgctacgcggccgacatcatttctggctagatctactaacatgtaatgttctgctttttctttctcatcttctagcagctctcttgccagtgcggcgtcctcttcttttgttgctcctctttttctagtgcctgcgataggatgaatttctaagtgcctatttttggcatgaattaatcgttctggtgagcttccgactaaatcacggtcttttaatttcataaaatacatgtatggagatggatttacaatgcgcagcacacggtataattcaaatgaactcactgacactgggatatcgaatcgctgtgagagtacgccttgaaaaatatcacccgctcgaatgtattctttgattttttctacgtcctgtaaaaattgctctttttcataggttgatgtcacatgttcaaacgacggtgattcgttcatattccctgataaaatcagttctttcatatcgatccttgtatggagtttgtgaatcatctgttcaagctgcttttgattttccttgtaagcttgtattttttcgtcttctgtttcattcccggttagctgggtgtattggataaaatgaacatgattcgtttcatgatcaaaggcaatcatcgtttggcaaacaaatagcgtacaattgtctgtcgttgatgcgcttcggtgaggcctgacagaaggttcaatgcttggaataagatcgtaacttaagtacccaactgccccgcctgtaaacgggatgtcaacgtctggtgtcttgatttgatattgctctttcatccagtctaataagtcttttagttcttgctttttcatgatctcttgccctgccgcatcacgtgcaatatattcgttttggtcatcgtgtaaggttaaaaaaggatgcaatccgatgaaggaatatctcgaccagctagaagactcatctttgctttctagtaaatacacaatatctgccttgagtttttcgacaatttgaatcggtgagagcgtatcaactgtaatggtttcaacaatcgggatcgttttgtgggactcgctgtcccttaaaaatcgggtcaaatttgattgggaattcataagcacactccttaaatgggattaaggagaatgaggggacatatagagggtttgtatgagtatacgaaataagcctaaaagaggggtgctcttttaggcagtatgattaaatagaagtatcgtatctctgctcaactctactcatctcaactaccctagtctcattctcatcttctctaaacttgcaatgccgtttacacctgtgtgtaaacttcggctgttcatatcgtattataattccttgttttttgtcaactgtaaatcagggcgaagcgtcacagcttcttccaagtacacatgctgcacatcttcctgctttgtgtctgtttggaccgtcattaacacacgaatacaatgttttaaaccgccttgaatgtccagctcctgcatacaagtaacaggcacatacgtccacccttcaaactgacgaagggcttttgccggaaaaacggagtgaatatcttgtgtagctgaaattaagatctgcacgacacgttctggatctacttgatttcttgaaattatcgcttctagcagctgtttcgttttatttaatacttctgtttctgtatcttctttcactgttgtagccccacgtatcccgcgaaacatcatagacatccctcctcccgtttccattcttcgagccattgatgcagatcatcttttgtgaaagactgcaagacagcatctccaacctgttttaataaaacaaattgaacggttccgcctcttgcctttttatcaccaatcatccggtcaacaaatgttttcgtggaaatatcttgagtgacttgtaccggaaatccgagttctttcatccactcttttagtttcgtacgattgagactgagtcccagcttcttttcgctcacatatagcgcaaactgcatgccgattgcaatagcatctccgtgcgtaataacgccgtatccatactctgcttcaatggcatgcccaagtgtatgacctaaattcaaaaatgcacgcacgccttgttctctttcgtctttttgaacaatcgacgctttgactttaatcccttgatacagtatatgtgccagctcgctctttgaacattccgccaaagaacgaatagacatcagttctgataaaaagtcttcacttgaaatgagggcatgtttgatgacctcagcaaagcctgacctcatttcagtttgagatagtgtctcaagcatgctcgtatcatagatcacggctttcggctgatgaaaggcaccaattaaatttttaccgagcgggtggttaatccctgtttttccgccaactgcactgtcatgcgccaatagcgtcgtcggaacttggataaaatcaatacctctcatataactagcagcaacaaagccagccaaatcgccaattacgccgcctccaagcgcaatgatgcacgaggagcgatccagctgaaattgaatggccttcgtatgaatatgctcaaactcagcaaaagatttcgactgctctccgcttggcacaaccactttatgcacagaccacctctgcttaagtaatcgaaccatttcatcaccgtaaatggcatcaaccgctgtatctgtcacgattaagagcttcgtataggaatgccccgtggaagttatcaagtcgacgatattgcgtttaatcccatcaccgatatatacaggataagtggctgaggacgtcttaacttccagtgttttcattaaaattccctctgaagctggcgcattttgtcaacattttctttaatgcggtcaatttgatcaaggccaaactgctcaactacagcattggcgatttcccaagccacgactgcttctgcgacaacacttgcggcaggaacagcacagctgtcagaacgctcaatgcttgcggagaaaggttcttttgtttcaatgtcaacgctttgaagcggtttgtaaagcgttgggattggtttcatgacccctcttacgacaattggcattccagttgacattccgccttcaagaccacctaagcgatttgtttttctcgtatagcctttttcttcatcccagatgatttcatcatggacctcactgccatttttagaagcagcctcgaagccgataccaaattcgacccctttaaaagcgttaatactcagaacagcacctgcaagcttgctgtctaatttgcggtcatagtgaacatagcttccgactccaaccggcattccttcaacgatgacttccacaattccaccaatggaatcaccgtttttcttcgcttcatcaatggcatccatcattttttgacctgcttcactgtcgtagcagcgaacaggtgactcttccgttaccttttgcaaatcttcaattgattcatatgccgtttgagctgctttcactccgccaatttcaagaacgtgaccagctaccttgatccctaaatgagccaggatttgtttagcgactgcgcctgctgctacgcgaacggtagtctcacgggctgatgaacgctctaatacgtttcgcatatcacgatgtccgtatttaatcgcaccatttaaatccgcatgtcctggtctagggcgtgaaatttgacgtttcatttcactctcttcttcttctgtgatcggctctgcccccatcacctttgtccaatgcttccagtcgttgttttcaacgacaagtgcaatcggagaacctaatgttttcccgtggcgaacaccgcttaacactttcgcttggtctttttcaatctgcattcttctgccgcggccgtgacctttttgtcttctagccaattcataattgatgtcatcctgctctatgtaaagtcccgctggaacgccttcaataattgtggtcaattgtggaccatgtgattcacctgctgttaagtatctcatgactcgatctcccttcatcgcattaacgcttttaagtaaaactataataacacacttactactaaaaagtcagctacatacccttcttttgataaaagaaagtatcagcagatgtcagtccaaacttttctgggtgaaaaatttgttcagttgaaccaacaaataatacgccatttggctttaaactgctgctcattttcatgtaaatctcttcttttgcctcttctgtaaagtagataaggacatttcggcacacgataagatcaagctgtttttcataaggatctgctaaaaggttgtgctttttaaattgaatgtgctttctcacttcatctttcacagtgtaaaatgaagaatcttcttttgtgaaatatttttgcttgatttgttctggcacctcttgcagtgatcgttcatgatatcttcctttttgagctgattgcaacactttatcatcaatatcagtcgcaataatttggaagtcctttacaagtgggtgacttgatagcagcattgagagtgtatacggctcctctcctgtcgaacatgctgcactccatatttttagggtcccactgtttttcgaaagcagcggaagaattttttgatcaagcacttcccagcgctgataatttcggtaaaattctgacacattgatcgtcattcgatccatcgtctcatctaatagtgctctatccttttcaagggcagccgcgaacgcttcaaaatctctatatccttttttatcataaagtgacgttaatcttcgtttcatttgcgcttctttatataaattcagatccaccccggttagttttttccatttcccgacaaatacttgatattgatccatcaaagtcctctcctgtctcatctatctttgtcctagtatagctgtttttatcgaaaatttgtatcttctcatgcgaaatttcgtatagaaatattcatataaaaaagccaaggtgctcatttgatgaacaccttggcttgagttttaataaatccaacttgagatggtttgatcccagtttgtgagttcttcttgtttgaagaataagttgatttctctttcagcactttctggtgagtctgagccatggataatgtttttcccaaccgtcaatccatagtctcctcttatcgtgcccggaagcgcttccttcgggtttgttttgccgataatctgtcttgtgacatctactacctgctcaccttgccataccattgcaaatactggtcctgacgtaataaagtcaaccaattccccgaagaatggtttttctttatgctctccgtaatgtgtttctgctacttcttttggaatactcattagttttgctccaacaagctgaagcccctttttttcgaatcttgacacaatttcaccgattaattgtctttccacaccatcaggtttgaccataagaaatgttttgtccatatacgttctccaccccgtcgtttatgtatgtataggcttacattgttacaaagtgatcgtatcatttttttatacaataatcaatttttgacaaaaaatttcacaaaaaaaccaatcaacaatatgttgattagaattttcgttttccaatatatttggcaatggaagcgagtgacgttcttgctcgtcctcgaggaagtttgtccagctgttcgaatgcctttttcaaatacatttcactcactcgaatcgagcggtcgatcgcatctgtttgtttgagatgttcaattacaggctttagctgcatttctgttgtttcactattaatcagctttaattggccttcgagtgtaggattcttcagtgcatataagaccggaagtgtgacatttccttgtaaaaggtctcctccaacaggcttaccaagctcttcttcagttgatgtgaaatcaagcacatcatcaatgatctgataggacatcccgacatagtagccaaaccagtaaagggctttatgtgttttctcatctgtacctgctgctatcgcacctaactgacagctgcctgcaatgagcaaggctgtttttcgtttgattcttcttaaatatgtacgcaggttttgatccatattgtatttgtctttcacttgctcgatttcaccaagacagagctcgacaaccatctttgacaaaatttcatgcgccattgggtgattgatctttgtcatatactcaagcgatcttgcaaacatataatctcctgtgtacatggcaattcgattgtcccattttgccttaatcgttggcttgcctcttctcagctctgcatcatcaatgacatcatcgtgaacgagcgatgccatatgaatgagctcaagcgcaacggcaacatatttaattttattaatgtcatagtcgccaaacatgcctgaaaggagaacaaaaacggggcggattcgttttccgcccgcttgcagcaaatgaagacccgcttcacttaataatgcataatcagagcgaactgtttgttcaagctctttttcaataatatcgatatcatgatttaaaaaagagatcattgcttttagtttcattattttcacccaaatatcgtttattcaaagcttctttccgatatgtgttgctgctacaccgcctgtaaatggatgatacgagacatcagacagacccgcctcttcgaaaagagccgccagttctttcatgccagggaacgctttggctgattcttgaagccatgaatactcctgatagcttttggcaaacagtttaccgaagagcggcatgatgtatttgaaatagacatagtagccttgtttaaacccaatcatttcaggttgcgatgtctctagacagacaaccattccaccaggcttcacgactcttgtcatttcctttagcaccgtcaagtaatcaggcacgttccgtaggccaaaaccgatcgtgacataatcaaatgtgctgtcctcaaaaggaagctccatcgcattgccgtgaagcaattcaatttgattatagcccccagttttcaccttcgtttctccaacactcagcatatttttactaaaatcaaggcctttgacttcgcctttctctccaacagcatcagcaagcgcaatggtccaatcggctgttccgcagcatacgtctaatgctttggctcctttttgaacattcatcagtttcattgtcttatcgcgccactttttatgctgcttaaagctgatgacagagttcatttgatcatagtttttataaattttttcaaatacaccgtgtactcgctgttcttttgattgctgcatgacttacccttcttccactttctgatgatacgcaggttcatttttcatatgatccaggcgatttaatagctctttttgaacgaccggagatgaaacaagatgctccttgattgatcgtttggccttttcatagccttcattctcaaagttgtcaaaacatgtataggcgtccgtatagctatcgttcaaaaaaagttttaaatgtttgtcgtcttctgcttgtttcatgaaacgtttataaacaaggaaacgacttgcaatctcattccaatgcgttaattgaaaatgctcagaaaccctttggaataacgcagactcaaccgttgctacacttttgtaaaagtgcgctgcatcttgaatggatcgatcatacagtctaattttatgttcattgatttctttgatcgccgttgcgagggtgcgaatcatgtagatgtctttcatgtcagagagaagagaatagtagagaccgctgaaatagtctcctgccaggatagtcagctgacgatttttgaattcgtcttgtttgatcgctgcagcagttgtgacttcgtcatgggtatcaagggcaatttgcacgagcatcgccgttaaaatataattttcttttttctctgcatcaatttgagcttcatcaaacattgcatgaaaaagaaggagcttatcttcatcgatgagtggcgcacgtaaatgtttcgccaaataaggatgagaaagctttttatttaattttatatttagattagataaaattccgtagatgtcttgcaaagatatcacccttgtcccaaaaattacagtttcatatgtagccctgcacattgtatagagatttattataccatatcagctctcacttttatgctatcaagtgcactcaagtatttatttctttgcttcgctttgaatttccccgaagcttgtttgaatgacagcatcgcctcttactttgattgctgacgtatgctcagtaaattgtgcaatgatgacttcacctttatcgagcttttcggaatggtgaaatcttgtatcagagcccctagttaggccgatgacatttacaccattttcattggctttaatcactacaaaatcagatgctttattttcactcaacctgttcaccttccatctattgaattagtcgtttttaataaaggaaagcacttctgctcttgccgctgcatcatttgcaaatgtaccgcgtactgctgaagttactgtttttgcgcctggctttttcactccgcgcatcgtcatacacatatgctctgcttcaacgacaatcatcacgccatgcggattgagtgtttccaccatactatctgcaatggttgatgtgatgcgttcctgaagctgcgggcgtttggcaacagcctctacagctcttgcaagcttgctaagtcctgtcacttttccgccgcgcggaatataagcgacatgagcttttccgtaaaaaggtactaggtggtgttcacacattgaatggaaagcaatatcttttacaagaacgagttcttcgtggtcttcaccaaaaatggttttaaaatgttcttttggatcttcatttaatcccgagaacacttcttcatacatttttgctactcgtttaggggtatcaagaagtccttcacgatctggatcttctccgatggcttttaatatatcgcgtactgcgtgttcaattagttctttatttatttcactcatgtattatatcctccaaaggcgattacatttcaatcagattctagcacacttcagatcctaaaagcaaaggagagcgttctaaacgaaccttttgtttcaaaaggaaaagccccttatgaaaggggcttttctagaccagtgtgaaactgtatatgtataactcctgcaataggatcattacacataacgattatttacctgccaccgcgtctttaagtgctttacctggtttgaaagcaggtactttgcttgcagggatttcgatctctgcaccagtttgtgggttacgtcctttacgagctgaacgctcacgtacttcaaagttaccaaaaccgataagttggattttgtcaccatttttaagtgcatctaaaattgtatcaaaaacagaatcaactgcttttgtcgcgtcttttttagataactcgcttgcttcagcaaccgcgttaataagttctgtcttgttcatgcctttcacctcctcccaaaaatatgcattcaatagattgttatcatttcttcacaattcatcttctttctatacactttttttgaaaaaaagagcgtatagaaagcggtatacatggcttttcattagaaaacaactctttgaaggaatgtttgtccaacaaagtgaagattttctgtaagtagattaacacatatgaaataccatatcaagcattttaaagggaagaatccttattcgtcaaggattaagggcacttttgcgaacgaatattcctaatttcagcctgaatctgactaatctttatacaattgtctttttatgactcattccatacgcaaaaaaagacccctgtcaatgagaggtctcacatgctatagaataatcgcgatcaaaccgcctgatccttcgttgatgattctttcaagtgtttctttcagtttatatcttgcattttctggcatcagcgacagctttgcttgaatgccttctctgacaagggagctgagtgagcgcccaaatatatctgaattccaaatcgaaagcggatcatcttcaaagtcttgcattaagtagcggacgagttcttcactttgtttctctgttccgataatcggtgcaaattcactttctacatctactttaatcatatgaatagatggcgcaaccgcctttagtcttacgccgaatcttgagccctgtctgatgatttctggctcatctaaactcatatctgacaaggccggagccgcaattccgtatcccgtctgcttcaccatttttaaggcatctgatacttgatcatattctgtcttcgcatgtgcaaaatcttgcatgagctctagaagatggtctttccctctaatttctacgccaaccacttcttttagaatatgatcatatagatcatccggggcgtacaggtcaatctccgcaatcccttgacccatttcaatccctgctaagcccgctctttcaataaagtcaaattcactgaactggccaacaacacggtcaacatctcttaatcttttaatatcctttacggtttccttcactgagtcctgatagctttctctcagccaatgatcttctttcagcaccatgacccagcttggaaggttcacattcacctctaggactgggaattcatataatgcttcacgaagtacactaaggacgtcttgctctctcatactttctacactcatggcgagtactggaatatcatatttttggctgagctcctgccgcagcgcttctgtttcaggatgatagggtctcacagagttgatcaccataataaacggctttccaacctctttgagctcatcaatcacacgttcttcagattcaatataatcatgtcttgggatttccccaatggaaccatccgttgtaatcacaacaccgatggttgaatgctcttgaatgaccttgcgtgtaccaatttccgctgcttcatggaacgggattggctcttcataccacggcgtgttgatcattcttggaccattttcatcttcatacccgcgcgcaccagggactgtgtatcctacacaatcgacaagcctgatgttgacatcaaggccgtcactcacatgaatcgatgccgcttgattcggtacaaattttggctcagtggtcataatggtttttcctgctgcgctttgcggcaattcatcctgtgctcttgcacgatctgcctcattattgatattcgggagcaccacgagctccataaactttttaataaacgtagatttccctgtacgaacagcgccaacgactcctaaatatatatcgcctcctgttcgttcagcgatatccttgaaaatatcgactttttccaagtgatcccctcccggacttgctatcctcgttttcaaataaaatactctattcttcaatcaaacttgcttgaaaggtgtctggacaatatatgtgtatgacgttgtcctatttgaatatgacaccttttttgttttgagagtatgtttagccataaaaaaacctttctcctcatttatatgcagaggaaaaaggttcattcttgtttatgacgtctttttttctaaaaaatcaggctcaccttttttgtttatggtataaggaacagaaaacgcgggtacaaacggggtttcctgccaatagacatcttgaatgttttcacctggtttcagcttttgtttcgtattcttcaaaatatgagcaaaatcactgcggtagtccacatagatttcgccatttgatgaaatcagtaatgggagggaattccctgtcacaggactcatgaccgtaggcggtgattttaagcctagctttttctcatttaacgtatataaattgtttgatactactttgccgtatggcggatatgtatgttcatcttgatatattttgattctaagccgtaattcactgatggtttgcgtcattttgacatcaagcagtttcacagttggttttttttcgacgtctgtgaggacataaatatattcccccccgccttcaaaggaagtagacggtacatcgtgtaaatatcttggtgacaagcgcttaaagtcgatgacgtacttctgataaaccggcgtgtctgcttctttcgtttcaatcggcaaaagaccatttgttgctttttgaaattcctcaatcgctgtctgaacgctttgcagctgctcttcgtacggcacacggttttcagttttgcgattttctggatacagacatcctgtgagtaatataaatgctaacaacgtgacactgacttttgctttgatcatcacattcttcctttttctttattcattgaccggcccgctaaatacaactaaaaacacaatgatacctgatatcagcatcaagctgtatgcgacggtcgaggctgttattttaagaaaccggcttttcagcttaaatcgactgaaataaatggtaactacagctaaaaacatgagccccatcgaaccaagtgcaaaccacatcttgattaaagcaaaactcatcgtgcctgtccccctttaaaacgaacaaattgtaagcgtttatatttcattctaaaccaaaaataaggtaaatatcaatcatttttccaatcattcagaaaaaagcgcataaaaaaaactgaagcaaagagggggactccgcttcagtcattaggtcgactatttttcctcattctgtagaggcaaagctctattcaaacttcattgctatgttatgcaagtcttccccttcttgcatcctctacatgcctaagttcagtcttccatttattttgtttgattttcaaacatgttcacaaggtcttccatttcatgtgttttcacacgtgccatcaatgattctacagcatcgtcgacctttttcccttcaaacaggacgtggtaaagtgcctctgtaatcggcatgctgactttgtattctttggagagctgataagcgccttttgttgtacggacgccttcgacaaccatccccattttttcaagcacttcttcaagcttataccctttaccaagcaaatttccgcagcgccagttacgtgaatgaacacttgtacatgtcacgatcaaatctccaacgcccgttaagccggcaaatgtcagaggattccctcccatttttgtaccgagacgtgcgatttcagcgagtcctctagtgatgagcgccgcttttgcattgtcaccatatccaagcccgtctgtgatccctgccgcaagagcaatgatatttttcagtgcgccgccaatttctacaccaatcacatcagggtttgtgtatactctaaagttgttgttcatgaacaaatcttgaacaaattgagccgcttcaatattttctgatgagacagtgacagttgtcggatgacgcaaacctacttcctcagcgtggctcggtcctgataagacgatgacagcttctcttttctcatccgggacttcttgttcaatcatttgagatattctgagaagtgtatctggttcaattcctttacttacatggacaaacggcactttcgacgtgatcagctcatttgcctgcttcaacacttcacgaatggcctttgttggcacagcaacaataatagcgtctgtcccctctaacgcctgcttcatgtctgtcgtcgcctggatagacgctggcagtgcgacatttggcaagtaatcatgattttcatgtttctcattgatttggtcaatgagctcttgtctatgtccccacatgtgtacattatgatgattatcagctaatacaagagcaagagctgttccccagcttcctgctccaagtactgaaattttcttcattctgctcaccctttttattttctcgctctcgcaaatattttaatcggtgttccttcaaaaccaaacgcatctcgaatgcggttttctaggaaacgttcataagaaaagtgcataagctctggatcgtttacaaacacaacaaaggacggaggcttaattgccacctgtgtcgcataataaattttcaggcgctgtccattatgagtcggcgttggattcatggctactgcatccatgatgatatcgtttaaaatattcgtttgaacgcgcatcgcatgattttcactagctgtaataatggacggcattaacgtatgaattctctttttcgtgagagcagacataaacaagacaggagcataatctaggaattgaaaatgctcacgaatgttttgctcaaattccttcatcgtacgctcatctttttcaacagcgtcccatttgttcacaacgattacaacggctttaccagcttcgtgtgcatagcctgcaatacgtttatcctgctcaataatgccttcttcaccatcaagaacaacagcgacaacatcagaacgatcaatggcttttaatgcacgaagcacactgtatttttctgttgtttcgtatacttttcctttttttctcatacctgctgtatcaacaatgacaaagtcacgctgattgtacgtaaacatcgtatcgacagcatctcttgttgtaccagcgatgttgctgacaatgactcggtcttctccgagcatcgcattcactaaagaagatttccctacattcgggcgaccgattaagcagaactggacaacttgttcatcatactgcgtatctggtaagttcttaaagtgttctgcaactgcatcaagaagatcaccaagacctaatccatgcgttccagaaatcggaaatggatcgccaaatcctagtgcataaaagtcatacacatcacttctcatttcagggttgtccagtttattgacagcaagtacaactggctttttcgtgcgatataaaatttttgcgacttcttcatccgcagatgtcacaccatctcggccattcaccataaagatgataacatccgcttcatccattgcaatttctgcttgatggcgaatttgcgctaaaaatggctcatctccaatatcaattccaccagtatctattaagttaaagtcataatttaaccattcagcagagctataaatacgatctcttgttacaccaggtgtgtcttctacaatcgatattctttcgcctgcgattcgattaaaaattgtagattttccaacgttgggccttccaacaatggctacgacaggtttacccatagtacccttcctttcaatccagccgcgattcaatatgttcatcatcatgtttcaaccgggatttaaaattttcattcagttttatgaaataaacccttcaaacatgaagggttcaacttatatattatatcaatttttaatcagaccacaatgaataacttaaaaatgtttgacaatcaagtaaagatcttctccaattccgtgtgcaattccatctaaaatggcctctaaattcatggcgtacatgtcgagttcttctttattttcgcagaaaaaaacggctgttccgcccatgacccgctctttatttgttgtagccacagcgagtataaattgttcaatggtgttcgccatgccctattacctcactttcttttttatgaactctgtcggcattctgatggcattttctaaaataggtacttcttccaatacacggacagcgagatcttcacgataccattgcggtaaaatgaacacaccaagtgtaccgttattcaaatcacgctttgcgagcggacagagtgatggttcaccagagtcgcgatacacaccaagtacattggataaatcaaataaaatggcctgccgctgcccaaggttggcaatcgttgtggctgcgttgaaattttttggtgtcaaaacaaagcccatcccatgctccaaaatgagcttttgcttttcaggcagtccgatattcatgatgtaaatatcgttcacataaagccctgccccatcaaagcgaagctctcctttttgtatgttgacgatatccttcaattggcttccagacattaatagctttgccaagaaaaaacaaagaataccgaccactgtcccaataacgagcgagaagaaaatacaagctgtggtcgtaatcagtgccgtgagaatcgcaatataatttcggctttcaaaggcaatggcaatgccttctatatatgtacttcctcttgagactagctcatatgaatccatttgagttaacgtatttctttccatattgcggacatctcggaattgtgtggctgccagcgtgagaaaggtaatcgccgtaaattcctcctgaatgagtgcaggcataatgatcgcaccaagtcctgaagcgataaaaccaagcgcaatgtgaatcacttgtccatgaatatatgttgggtattgccggtaatctgttcttaacatgtaaagccttgccgccatcccaaagatgacaccaataatcacaggaaacgtataatccgtcatgttgattttgcagccccttttactggttttcttgatgaatgggcgttcaagagtttttcaagctgatcgacacctaataggaagatggacccttgaacaacaagggacagaaaagagagatctcctatgacaatcgatgatgtcaggcggtgaatcgtgagcgcataaagggcttcgccaagacatacagccatcatccataaggtgacacgttctgtgaaatgatgtccatatgtcaaagacatcaagatcagcaaggcaaatacgacccaatccacttttattagcgtgaaccaaactgggtcatataatgcaaaaatcataaaaaaggcatatgcgctcaccatagaacctaattgtatgattctcattatttgatgcccagaccggaatataacaaaacacgcacatgcatataaaaaggtcattaagtaccccgcattcaggatcatatcaaatatagatatcatgaaatgactacatataatatggacaaggacaaagatgcctagcacattgcgccataagcttttttccataataaatgtcacgataatccaaacgaaccatatggaccaataatagtacaaagcctccaacgtctcatcacctcaattacattatgggaaaatccccaatttttaaacgtaagggatcgctttgggcattgtatgaaataaacaagaggtgacaccctaatagttgaggagggatgcatgatgggaaaagatagacaggaaaaacgcttaaaggcatcaaaaagagtggaatctgaccgtgatcaatccattcatcataaaggggcaacagcattagaaggtccagatagcgcgcgaaaaagaaatcaataaaaaaaggcatgtgatgaccacatgccttaaatgatgaagggctaaacttgcttttagtcctttttcttatttgatcttaaactatagtacgttgtgtcgatgcctctttctttgagccaatgactcgtttcacctgaaatgactaatggggtttgtctcagctcttcaatggtcttcacgccaaggactgtcatcatcatcttcacatcttcttgaagatctatgatatcaccgatgaggccgctctcccctccgtcagtcagtgattttaagaaaaaaccagctagaccagcagcggatgcgccaagagcaattgattttgtgacatcaagggcgtcttgtatacctcccgaggctaaaaccgtttggtccggaaaacttgtatgtacttcagcaagactcgctgcagttggaatcccccattgattaaaataatgaagtgctttttggcggcgaagattttcgatcttagaaaagttcgtaccaccaaatccgcctacatcaactgcggcaatcccagcttgaaataactttttggccgtttccttgctcatgccaaatccaacttctttgacaacaacaggcacacccactgtttcattgatggctgcgatacgctcaagtgcccccctgaaatcacggtctccctcaggcatgacaatctcttgaatcacatttaaatgaatctggagcatattggcctccagcatctcaacggcttccttcgcttgctcaatcgttgcctcactgcctaagttcgcaaagacaattccatttggattcacttttcgaacaacttcatacgtacgtctttcctctttatctttcagcgcagccatttgtgatccaactgccaccggaatattggtttccttcgctgcgattgataaagagcgatttatctcataggtcgattttccgcccccgccagtcattgcattgataaaaattggcgaaccgaaaatcagtccgccaattgttgtatgtgtatcaatttgtgatgtcgcaagatctggtaaaccgacgtgaacgaaggaaacatcttttaaacctgtttctgcatgctgtccagtggacaaggcatgttcaatatgctgtttctttctttctgctcgcgtcaattttgatcaccaaattattttaatttattgagcttatcgccgatcaggtcaccaagctggaatccgcttgtgttttcttctttcgcctgatattgacgataattctcttcgatttgtttttcaggattttcttctaaatcacggatgcttagtgaaatgcgctcttcatcttcattcacatcaagcacttttactttcacagtctgcccttcttcaaggacttcatgtggtgtaccgatatgtttatgagagatttgggaaatatgcacaagtccttcgacgcctggcagaatttcaacaaatgcaccaaagctcacaagacgttggacagttccttcaagcacatcaccttgttttaccttttcgccaatctggctccaaggtcctggtaatgtttctttaatagatagtgagatacgctcgttatcacgatcaacagcaagtactttgacctggacttcctggccttcttccactacgtcagatggcttttcaacatgcgaatgggatagttgagaaatgtgaaccaatccatcaatgccgccaatgtctacaaatgcaccaaaatcagtaaggcgctgcactttaccatcaatcacactgcctacctcaagtttttgcaagaagtcttgctttttgtctaattgctcttgctctactactgcacggtgcgagagaatcacacgatttttttcgcggtccagttcgaccacgacaagtgagagtgttttacctttgtagtctgaaaagtcctcaacatagtgcgcttctacaagagatgcaggaataaatccacgcacaccaatatctacgacaagaccaccttttacaacgtcttttacttcagcttcaaatacttcttttgtttcaaactttttctctaggtcttcccaagcgcggtctgcatcaacagcacgtttcgataaaatcaaagcatcgtcttcgacttttgttactttaagctctaattcgtcgccatctttcacgacatctgatgctttttcaacgtgaagacttgataattcactgattgggatgatcccaggctgtttcacattgacgatatctacattgacatgcttgtcctcaactttagaaacaatccctttcactacatctccaacctctggtacctgaacatcgatttgattcatttcctctgtcatttcgataacctccttggtccaaacctacacagcttagttaaaacgactgggtgaatatgtgtcttaagcatgatgattgccagccgagtatgtattatagaaacattcaaatcaacagaattgcttgaatgatcaataaaaatagtattagtataaacttctaataaaagaccttgtttgtcaagagataaacctctaacttataaaagttttctaaaatttcttactgtttctccacgcggtctgctgcatctaaaattttacctgctacctcttgaatggaaagagaagtggtgtcaatttcaatggcgtcatccgctttcttaagcggtgaaacttcgcgctcagagtcaagcttgtcacgtcttgcaatctcttcgatcagctgatcgtaattgacatcgtagccttttttctgattctcttcaaagcggcgttttgctctttcttctacagatgcaagtaagaaaattttcacttcggcatcaggaagaacgtgcgtacctatgtctcttccgtccatcacgacaccgccttttttaccaagctcttgctgcctgcggaccatttcttcccgaacagctctgtgctttgcgacaaccgatacttggttgctcacgcggtctgtgcggatctcctctgtcacatcggtattgtctagatgaactttttgaccctcgcctgttgagacaagttcaatcactgttttcttcagtagtgcatcaagcgcctgctcgtcttcaagatctacaccatggtgaagtgccgcaagcgtaatcgcgcggtacatggcacctgtatcgatataaatataagatttttttgctgcgacaatttttgccacagtgctttttcctgctgctgcaggaccgtcaattgcaatagataatttctttttcataatacctctccttgattgaatctcccttatgaattgtaacacgatcaccggtcaaacgggggaattttctatcaatccttctgcttaaacgtctcgatccaatcttcaatgctcatgttatttacaccctcgtattgcacgacttttgacaaaaatagctctccttttgtcaaatgaagtgtgatctgaacggctaataataagacaagctgaatgagcaccgctttcaataaccatctttccattgtcttcataacaaaaagcctccacgctagattctattacctctagtatggaagcttttaacatcctttattctttatgcttttttcacacgtgttaaaagctgctgctggaagcagtacttcataatgtgctgctgctgatcatttgtgatctcagaaaactccatgatcgctcttgttttgccagtctgctcatcttgatagactcggctcatctctgcaaccgctttaattttgacaggctctttcagcggaagttcaaactctgtgatcacttctccgtattctttcattgagacaccttcaggaacagcaatggctaaaccgccagcactcatattgacaataaacgtgtcaaaggattcttcatccgtttgcgtaatcgaggctttgaccattgtatcgactctcagatattctctacgctgaagccgaatcatttcttcttttggcggaatggaaatgacgatcatcggaatatcttctttcctcttgccgatgacttcgcttgtgcatttgtatggaacttgattttcatcgaaaaagaaaacggtgatttctgtttgctggtttaaatagattgtgcgtcctgtttctttatcagctggataattaatgcaaatatcatcgttattattttccaaaactttcgattttgcagttttcacttctttgttctcattgacatattcaattgtgattgcatcccctatttgtaacattcctcatcactcttttcatctgtgaaatcatatcctctcctatattaaaccatgtataaaacaaaaggaaaaggcttattcgccttttccttgctctcttttttataggtctttatatacaggttctgcattttttagtttatctactcgctcttcttttccagtatctgcattaatgaacattcgatacgtatcattttttatcgtcccaaggaactcatagcataaaacttcctctgacatatcgttctgaacaatcgctatatgagcatcttcgattttcacatgctgattgagcgttttcttcgcttctttttgtgagattttaggtgctttgatgtctcttgttttatgattcgttaaatagtctttcgctgaaaatccaaccacttcaccatcgtctaatgcgaccttcatgcgtatactatctggataaagcagtacatttttttgaagaggaacataggtaaatacaccgatattatcaaattgcgcactttcatctaaatggaacgactctgcatcaaatccttgcttctttaaaaagctgagtgctttttctgatgcttgatttaaactgattttctgttttttcacgtcacgattttgaagaaggtaaactggatgtcctcctttttcagtcaagtctaaatagaaattcgctttattatcaggatctgacatcgataagctgtacacatctcgattggttttgcttccgctttttctcaccttaaaatgttgattatgatcaggtgtgaattgctgggcaatgcgtatcgcttctttctttgaaatttttttaccttttaaatgattgtagccgcgtgtttctgcttctgtcgacacatttgtcggtccgagatcgacatctgcaaatgcatctgcatttctctcgactgttttcaacccgtcaatgatggtgttatcattctttcggtcaccatcagcaagtgccatttcaacatccatccattttaaatttttgttgaggacgagatgctgcacttgtctcagttcgttttgaatatcagatgcttgttgatataaagacgtaatggttttgtgcgtatttttgtttaatggttcatctgataaggatttgactgatgatttgtagctaaagtctccgacattcgccaaaaattcttccgttttgttaaaaggcattaatgtgagcggaagctgactcacattgttatgtgcttctgatgacattctccatacatctgcaagtgctggtgaaatcgacgattggctgttcatcgcaagcgttgctccaagtttgtcgtgcagctgatccacttggtacgttaaatcgtggaaagccctctgatagttgttctctgcgtgcagcagcactgcgtctttttcttgatgctctttatagccccaataacctgttgagatgacagcaattcctaaaatggcaatcaatattcctctgatcatttatttacacctctttttattcgcagaaaatatgtttcccgatgcgtttaatttgtggtcttccccaaatccatggacttgttgctgtatcaggattaaagtaatagacggcactctcagaagggtcccagccgttaatggcatcaaacacagctttttttgcagtttcatttggtgacatataaaattggccatccgccacagctgtaaacgcaagcggttcaaaaataacacccgcgattgtatttgggaaagtcgggtggttcaatcggtttaagataacggcagcgatcgccacctgtccttcatacggctcgccccttgcttcgctataaaccgcttgtgataagagctgaatatcattactagaaaaaccacctggcatgttggctgccgtttgtttcggtgtttgagttgcttgctgattgcctgattgtttcgcatactttccagatgctccgctttgacttttttgattctcttttgcgccttgagctgtctttttttgtgagcttcttttcgcaggagcttttgtttgctgatcaagaggcttcccgccataatgggtaaactcattcccctttttcagctgctgctgaacaaagtctttatagtattttgtcttttgaactaataggttttttgtttgtttacctacaagtccgtctactttctttacaccatattgactttgaaagttgcgtacggcccagtacgtcccccagccatatacaccatcaattttgccattataaaagccattgtattggagccgtgcttgcagctcgacgacatcttctcctgttgcacctcgctggataacttgactggtgaaggcttcacttttttcagctgtcatcagtgaggttgcgagtagaacgattgagaagataaggacgatttgtttcatgaaacgagctttgtccatatttgatcctcctgtacttttgatgtttgaatatatatttcttccgatccctatttttatacattcatcacaggagagaatgggatgaaaagacaaaaaaacgccctatcaactgataggacgtttttccacattaaatctgcaccattttcacggaacgagccttttttgcttttcgcaggccaaaccaccataaaaaaatcatgaagggcagcatgatatatccccaattttccatccctaacaatatgaaatcataaaggccgtgaaaaagcacaggaagcgttaaagaaaggatcagccatttgcgctgctcctttttttcagagaagcgggctttgccgatataaaaccccatcacaacaccgaataaagcatgacttgagacgggtaataaagcacgggtaaacgcatattcaaccccgtgaccgactaaataaagaatattttcaagtgttgcgaaaccaagtgagacacttgttccatatacaatcccatcatagtgttcgtcaaattgggcatgcgcatagacgctgaccattaaaataaaccattttaaagattcctctaaaaagcccgacgtcacaaatgaaatcaagatagggttcgttgcgatatgctcctcttgaaggacatattgaataaacatggttggaaacacaagaataacgcctagcataaaagatctgatgaccatgtgaaccggctcattgtcgtattgatctttcaaataaaaataacttaaaagtgcgatgccgggagctaatcctgctgagatgattgcgatcataaccagacctctttccctacattatccttcattatcgtaccatgatttaccctttttttatatgactcgagcccatttttatgaaaattactttctatataatcccattttatatcaaaaagaaccgaatcccttagaaggatccagttctttttttatccgttcattcttttgttgatttcttctgcaataagccccccatgaaatcttccattttcaatgaaaatttcattggcattgtttccagctgcaatcactcctgcgatgaaaataccttctacatttgtctccatcgtctcttcatcaaatgctggacgacctgattcttgatcaattgtcacacccattttttctaagaaagaatgatctggatgatagcctgtcatggcaaaaacataatcacttttcactcgctctgtttgctcttgctggttagtaaaaatcacttcttcttctgtgatttccttcacctgcgctccaaactccattcgaatcgttccattccgcacaagcgcttcaaactctggcaaaatccaaggtttgatgctagatgaatattcagtgcctcgataaagtacagtgactctgcttccacatttcacaagttctagcgcagcatcgacactcgagtttttcccgccgatcaccgttacatctttatcaaagtatgggtgtccttctttaaaataatgatacacatgtggaaggtcttctcctttaacgttcatatagtttggatgatcatagtagccagtagcaatcacgacataatcacatacatagtcgtcttttgatgtgctcacggtaaaatgaccgtcttttttcgtcacagcgttcactttttcaaaagcatgtacacgcaggctttttcgtctgactacttctcgataataagaaagtgcctggatacgaacgggcttgcgattttcagtaataaaagcgacatcaccaatctcaagcttttcacttgaactaaaaaaggtttgatgtgttgggtaatgataaatactgttgacgacattccccttttcaatgacaagtgcatcaattccaatttgcttgaatgcgatggcagctgatagcccgcatgggccgcctcctattatgatcgctttttcttgtttcatttgttccactcctgtcgtttcaatgcaataacaattgctagctgtttatgagttgttccattccataaaaaaatctcctatttaaggataggagattttaaggcacgatgcaaatgagccgcttaaatccagcctctgaatcgagaagcttcagccattttacgtacgccgaccatatatgcagcaagacgcatatcgatgcggcgattttgcgccatttcataaatattattaaatgatttcaccatcatatcttctaaacgagtttcgacttcctcttcagtccagtagaacccttggttattctgcacccattcaaagtaagaaaccgttacaccacccgcactcgcaagtacgtctgggacaagcagtactccacgatctgaaagaattttggttccttcaagtgtcgttggaccatttgctgcttctacgacaattttagctttaatgtttgccgcgttatcttcagtgatctggttctcaatggctgcaggtactaagatatcacaatcgagctcaagcagctctttgtttgtgatggtatcgttaaataatttagtaacggttccaaagctgtcacgtcggtcaagcaagtagtcaatatcaagaccatcttcatcgtataacccgccgtaagcatctgaaatccctacgattttcgctccggcatcatacatgaatttagccaagtagcttcctgcatttccgaatccctgtacgacaacacgtgctccgttaatgtcaattccttttttcttcgccgcttctttgatgcagatcgtcacaccttttgctgttgcagtatcacgtccgtgtgatcctccaagcacaattggttttcctgtaataaatcctggcgagttaaattcatccattctagaatattcgtccatcatccatgccataatctgagagtttgtaaacacatctggtgctggtacatctttcgttggaccaacgatttgactgattgcacgaacatagccgcggcttagtttttcaagctccctaaatgacatttctcttggatcacagataataccgccttttcctccgccataaggaagatccacaataccacattttaaactcatccaaattgaaagcgcttttacttctttttcagtaacgttcgggtggaaacgaataccgccttttgtcggtccgacagcatcattgtgctgcgcacggtaaccagtgaaaattttcactgatccatcatccattcgtactggaattttcacagttaatagacgaattggctccttcagcaattcatacacttcttgcggataccctaatttgtctagcgctttatgtatgacggtttgagttgactttaaaacatctagcttatcttctgcgttatgagcggcgttttgatcggctgccattaaaataaaccccctagaaatctttcatgatctactgctccctttcaagcaatagtatacaccttcgtactggtaaagcaaaggtaaaaaacgttttttatcaaaataaaatatcagcgtttataaatataaaaaggatataaaaaaatactgttgtttcatcacaacagtattaaatataatagaaaaaagtgattaaaaatacatttgaatcgttttcactgcatcatcttgcatgatcacttttccgtattcttttagccgatggatcgttaatgtcgtaggagaaccgaactccgctaaaatggaaatgacggtatcagcagacagttcttcaaaatcatctaggctgagaaaatattgaccttcataatggtaaactgtaccccctaaaagtccaatacgacttaaactatgggacagttgaatcacatcttcaaacgaggcaaattgatagagcacatgatgactctcgtcgagcttgacttgcatctcaatgtaatcttcatcaaactcttcatcatcatcctcatcctgctgactctttgtgacaatgacgaccatcccctgcgcctgaagtgaaaatacttcaacagcaatcggtccactcgcttcaaaaccgagctcctgattcgcttcgttcatcatgtctttaaacagttgatggactttgaacgaatctttccaaaggtcttctttcgtaagaccccggtctgtcaggtcatctagtgtgagaaaaattttgattttattataattcagacgctccagtcgcataacgttccctcctgcctcttctaaacacacatcatactgtagtatatgagatgatgagtcataggttcttaattttgtattcagtttacactgtgtcaagacggaagacaagcatgaagctatgcttccggtgacttttatggaaaatattgagggcgcagcaagtcatcgcgttttgacaggcattaaatagatcagatgagtttctggttctgccccgagacgcattggaatctttgttgttccatagccattactaatgagaaaaaatgcgcctttgacctgacctgttcttcctttttcatacggaccaaatttcccaattctgatctgacctccatgcgtatgaccgctcagaacaaggtcgatcccctcatcttcactcattaaatgatgtacatctgggttgtgtgataagagaatatttacgtcatctttcacaaactcaggtcgtatcgcttcataatccgccttttcaagccgaatatcgtcgatgcctccaattttgattggctggccttcgaaatcccacacagctgtttcattttgtagagtcgtcacatcgcaagcatgaagaatctctttaagcttttgctggtgcagctcgtgatcattatttccccaaacaaaataaacgggtgcaattcttgataaacgtttcacattttcttcaattctggcgtagggtacacctttttctgctaagtccccgcctatcataatgacatccggtttttcttgtgtgacttccgctaataatgagtcactaatcagccgccggtgtgtatcagaaataaagaaaatcactgctggtcgatctgattgaagtgcttctattgtaaagtaatgctttttgatgttgttttgttttgccgttttcaccatttttgccgttacacacacacctgttgtaacagccgcaatggcggcagtaaatccgatggcatatttcatcataaatggctcccttgcatatgtgtcgttcataagacgcttgaatgaaaaaagacgtttcaactattaaaacgtctttttacacatttatttactttcataatagagattaatgtcatattgctgctgcatatagtgaaaaaccgcttcacgctctttccactggtctgattgcggccataagtctgtgcttttttgtataatctcacatctgaggcgatgatattcatcctcagccttttcttcttttttcttataataataagaagcataaaaagcaaacacctcagccattatccaaaatagaaaaacctcatgaccgagcagtgttgcaatcatcgcttctggctgaagagagcctcccatatttgccgttatcacaaaataaaacaaaagaatcgccagtgacaaaatggctgtccattgccaccttttgcactgcttggcaaagccctcatatttgtgctttcttttgatcaatgtttccatcattttcagtgtcggctgatccatatagcggctgattgcgtgcaacgtcatcacatacaccctgtcccttttttctacatatgtatgtgctttttcattcgttcatgtcaggtaattagttttccaatggaatgttgagcacttgaccactgtatacactgttcccatttaaatgattgtaggcttttattttctcttcacctgatcggcttttgtaatatttcatcgagattcgatacaggttttcctctggtccaacagtgtgctgcacgacacggactggcttttcttcctgcttctttttctcttcggcttcttttcgttttttctcttcttgctgtttttggagagctagctgctgctgttcacgctttttcgcagctgcggctttttcacgctcttttctctctttagcagctttttcttttttcttttgttctgctttttcttttgatcgctgcttttctttttcttcatctttctttttcttctcttcatcagacgcatccgctttatcagcggttgcgtcattttttgtttcggctagtgctgacggaactgggtctgtgtcagcacttgaggttttatcaatgtatacatcctgattgttattatcgttaatttcctttgatgtgtagtagatcaatagaaagaaaacagtgatgacgataataggaaagataatagccaatgtcgtaaacaaaggattgcgcacttttttcgtacgctgcttcttatattcatgaaagtcttctcgcgtaggaaagtgagagtcatcagaaggatgtactttttcttcaagaatttcctctacattgtcgtcatgattgtttgtcagctgcgccttctttctctgcattctcgacatttcttccatgttcatccctccccttatatttcaaacgaatttgacaagcaaagactaagtcaatgacaaaatgtgtcatgacaggaacaaataaattccccgtccactcgtataaaagtcctaaaaaaatactaatggaaaccacgaggataaacaagagtatttttgataaatagcgaaagtgaagaagcgcaaacacaatgctggcaatctcaagtccaaattgctgttgaacaattccgcgaaatagtatttcctctgaaaaggcaatgagaagtgctaaccaaacaatatgcgggatgcttcggtttttgaacatcttttcatttaaaccgccatcatcatacatatgagcaggaaacaccttcatgacaattgcatccacaataatgacgagcaaagcaccgccaattccatatgccagaatgcgcatatcacgaatctgccaaagggctgtaaattccgtccattgatcgaacataaatatgcctagcaaaaaagaaacgataagcatgagcaactgagtgaaatacagctgttctacgacttgtcgatcggttaatttttcaatgattcggcgatgttgttcaatcaatgctgcgcctcttttgtcagatgaaacatacgatccagcacagtcttccagtgtttcatttcattcagctccaatgattgttcttttttttcataatcagacaggttcagcccgcaagaagagcagcaataatcagaggattcgcgctctgtttgatcaagctgttcgtgaaaatatgataacagagattgtctaaagcagtcatgatccatgatcagctctttaaattgccacacttttctcagcttttctgtttgtctgtcctgtaatttttcttttagattcataaggattgccaggcgctgttctgactcatgcatcatgtaataatgcgtcagcattcttgcacgcgtctcctgaagccctgtttccatcaatcgttcacgtaattttttttcatcatttgtctgcatttgtgtcagttgggctaaatagaaatcaatttctggctcgtcaaatccttctgcttggatcaagtgttgctgaatatctgcatcctcttctgtatataaaagaatgctcacactgtttttgccgtcccttcccgctcttccaatctcttgcataaatgcttcaatcgattgcggagggctcatatgaatgacaaatcggatattcgctttatcaattcccatgccaaaagcactcgtacagcaaatgagatcaagctgaccgctgataaattgctgctgaatgagcatacggtctcctgcatccattccgccatgataaaactcaacacgctgattgtttttttgtttcatacagagagcaagctcttctgtcatttgccgggttgggcaataaataatgcctggtccttgcagaaaatccgcaagctcaatggcccgtttctcttttgcttctttcgattcgtgcacttctttgactaaggcaatgttcggacggttgacagaatgaatatgaaagtctggatgctgtaatcttagtgtttgcacagtatcttttagtgtttgtttcgttgctgtagctgtaagagctaaagccacaggatgacctaacacttctctccattctccgagcttcgaatattcaggacggaaatcatgcccccattctgatatacaatgcgcttcatcgacgacaaacagaccaatacgcatcgatttgagctgttcaagcagcacttctgacattaatgcctcaggtgcgacaaatagaaatttatatgatggcaaatgccgaatgatatgtcgcttctcctgaaaagacaatgtgctattaagcgccgctactcgtttttctccgcgcattttcattcgttcgacttggtcctccataagcgataaaagcggcgaaataatcagaaccaacccgtctgtcatataaccgggaatttgatagcaaagtgacttccctccaccagtaggcagcatggcaaccgtatctttttgttgcagtacacttcgaataatgtcctcttgacctgctttaaatgtgtcatggccaaagtatcgcatgagcgtctgatgaagcttatccatttgctttcaccatccttgtcagtgccaatcgtatttgaaaataagtaaatggatgctcgagtttttctttaatcagcttcattttatttgtttgcagccctctggctacagcaaggatctcccgctgctcttttatactcacatagggatctattgaaaagcttggctcatgtatcgacagctccacgatatgatcttcaatcgttgccttttttaatgaacgaatgtgagcaatttgttcaatatcaaatcctttttggacaagctcaagtgttttgtgagtagaagttgttaacacgcgtttgaattcaaggtcacctacgagctgctgcaaaatcggcgcctcacctttttgggcagattgaataaaataatggagtacattccaaaaaagtatgtacacataccacacatcttctttcatccactccgccatttgctgatacgtacgcccgattcgttcatttgaggtcaatgagtaaacaaaaatcagtgcctcttgatcacttaggttgattaggaggtgttctatttcatgatgcagatcttctgaaagcttgcttttctgctgatgctgtttcaaaaaagacttcgtccagctttgaaccgagacatctctttgtattggaacatattgatgcgatccagccatatggtgagaaagcacttgtacaagtaaagagagcctcatccatagcatctttgctttatcatggtatttggcaccatgaaaataagaaggcatcggtttttcagaaaaatgctggtgcagcatttgcttccctgcttcagtgatgctgagtgtctcatcggtttttctaatgtagtgcttctcttcaagctttaaagcagaacgattcagctgatccctcgtaaaccccgggtaacagccgaagtacctggaaagctcaaacaagctggcgtcctgtatggtttgtgatgatttttttcctttaaaaagatggtagacagcactaatggagcgttcgccgttcaatttatatacgctgtccattaacatgacatccaaataatgaagagtcattcatcaaagcacctgtcttcctgacaaaattcgaatattttctccctttattttaacagatttcatacaagaagaaatgtttaaactcaatttatgggggaaagttatgaacaaacccttatgtgataagcattctcaatcactttacagttgaaatgtgaatttaaaatcattacaataaggtttgaggaaatcgttttttatcggtgaaactaaaaaggttaaaccatgtgttccatcgaactatttgggaggtatttttttaacatggcaaaatatacaattgtagacaaagacacatgtattgcttgcggcgcatgcggtgcagctgctccagacatttatgattatgatgatgaaggcattgcatttgttacgcttgacgacaaccaagggactgtagaagttccagaagtacttgaagaagatgtgcttgatgcatttgaaggatgtccaactgactcaatcaaagttgcggacgaatctttcgagggtgacccacttaagcatgaatagtataaaagccccttatgcaggggctttttttatattaactattttgaagtcggcgcttattttcaaaccatggacgcattttcacaaaaatgaagctaaatacgatggtaatgatgattcctttaataaagttaaaaggtaaaatccctgctgtaatggtcgtcttgagcgcatgatctgatagttctggtgcgtttaaaaaccatgtgtaagctggcaggaataagaagtaatttaaaatgctcatcatcacagtcataagtaatgtacccatgatcattgaccaagccattccttttgctgatttaatttttttgaacataaaggcgactggtaagatgaatagtgtgcctgcaatgaagttcgcgacttgcccaactggaacgccggacatactgccttgaatgagataatgcagaacattttttaatgcctcaacggcaattcctgcacctggcccataaattaaaatcgcaataatcgctgggatatcgctgaaatcaattttcaaatacgctggaagccctgggaaagggaaatccaataaaattaacacgaacgaaatactgctaagcatactggtgacgactaaacgttttactttactttgattcaatattctctctccttttcgatcaaatctttcgaaaagaggattgttcaatttcagccacaaaaaaaccgctcatgaaaacaggagcggggaatttaggctagacaaataaacgtgtgaaaaaccaagttttcaacgtttacgaacctccatcttctcccatccagactatactgtcggcttcggaatcacaccgaatcctgccaaaaaaggctcgcgggcttagagactatgctcatcaccgccggtagggaattgcaccctgccccgaagattgatcattattcaattcgacatcattatatatgatatatgagcatttgtacagataaaaatcctgagcaatttcatcagttttaagaaatcgcaaaaaacttaaaaattataatgacaaatgcgaaaaaattggttatcttttgtttaaaggtgtccattcttgataaagacaccaagaaatgttcgtgttttctttttcgctttactgctttaatttgattgacacagtgaaaaggaatatggtaaattatcagatatttatgacgtttattttaggaggaaatcttacgatgtttcgagtattagtctcagataaaatgagcaatgacggtcttttaccacttttagaatcagattttgttgaaattgtccaaaaaaatgtaacagaggcagcagatgaattacacacatttgatgctttacttgtcagaagtgcgacgaaagtaaccaaagagctttatgaaaaaatgacttcattaaaaattgtcggccgtgccggtgtgggagtagacaatattgatattgatgaagcaaccaagcatggcgtcattgtgatcaatgcaccaaacggtaatacgatctccacagctgagcatacatttgcgatgatctcttcactcatgcgtcatattccacaagccaacatttctgtgaaatcaaaagaatggaacagaggtgcatatgttggtgctgagctttatggaaaatctcttgggattgttggacttggcagaatcggaagcgaaattgcccagcgcgcaagagcatttggcatgacagtcaacgtatttgacccatttctgacaaaggaacgtgcagaaaaaattggtgtcaatgccaagtcacttgatgaagtactcgaagtatcagatatcatcactgtacataccccgttaacaaaagaaacaagagggcttctcaataaagaaacaattgcaaaaacgaaaaaaggcgtccgcctagtgaactgtgcacgcggtggtattattgacgagcgtgaccttcttgaagcgcttgaaagcggccatgttgcaggagctgcactcgatgtatttgaggtagaacctcctactgataatccgcttgtagatcatccgctcgtcattgcgactccgcatcttggcgcatcgacgaaggaagcacaattaaatgtagcggcgcaagtatctgaagaagtacttcaatttgcaaaaggactccctgttatgtcatctattaatctaccagcgatgacaaaagatgagttcaaaaaaattcagccttatcatcagtttgcaggaaagctcggacgtcttgtctctcaatcaatgagagaaccggtaaaagaagtaggcatctcttacgagggctctatttcaaaactcgaaacatcctttattacaaaaagtctcctgtcaggctttttaaaagagcgtgttgattcgactgtaaatgaagtcaatgctggaatggtggcaaaagaacgcggcattagctttagtgaaaagatttcttccagcgaatctggttacgaaaacagcatttctattgaagtcaaaggcgacctttcaacctttactctaaaagcaacctatatcccgcatttaggagaacgcgttgtttcaattaatggatttaatattgatttttatccagatggacaccttgtctacatccagcatactgatgcacctggtgtgattggaaaggttggacaaattttaggcgaccatgatgtcaacattgcgacaatgcaggtaggacgtaaagaaaaaggcggcgaagccatcatgatgctttctttcgacaagcatcttgaggacgaaattgtcaaagaattaaccgaagtgcaagatatactttctgtgcgtctgatcgacctataaaaaatcatgataaacctcatgcaaatgcatgaggtttattgttttgaaatcattaaacgatctcccgttcggatgagatgagtggacagctcattgatctttttcaattgttccacagtcatctcatgcgcctttgcaatcgaccaaagggtatctccttgtttaatgagatatgtattgttctcttgtccgtttacatgtagagccggctcttggaagcgatccatcgcaatgattgtgagtggatctaccgcatcttctttgctggctgaccaatgacccctgtgcacctcaaaatgcaaatgagtgcctctagacgcccctgtgttgccgataatgccaattggctgtcctgcttctacatggtcaccctttttaacaaaacgctcatgtagatgtgcatagacggtttcatatccatttggatgctggataaacacaacctcgccatatgtagcagatacatacgaacgcgagaccacaccttcacttgcagcaaagatggattctccttctggcgcagctatatctaatcccatgtgcgagccgcctcttgtcccaaacaaatccgtgacttctccttttatcggctccacccattcgcttgtttcctgtgcatgagcaaaaggcgaaaagatcatcaaaaaacagctggcacatatgaagcaataccttttcatcagtgactccccttctttgaggttctttttatgacagcttagtatacagcaaggaagctattttctatacatcaaaaaaaagaacgcaatttctcgcgttctttaacggtcttttatgacaactggattcggcagagccggcacctctatcggttcttctaattcatacggacccacttgatctgttcctgcctgttgaatggtaacctctgtaaaaccaaaatctttcgctgagagcagcagaccttcaatgagtaaaatatgatcatttgagtccgataatcgcgctgttgctccaaacgtaatggtcacatgttttcctttagacgtcacttctttaatcggttcgtctttaattaatggatcaagtcctgcatcgcttgtacgcttcatggcttctaccgcatcttcatacgatgaataatgcgcttttgacggcaccaaaaaagtcccgctcttattctctaaaacataataagcgtgctttgtttgtttttcaatcgatattgctccaacgcttccatttgccagttgaaggtgagaccctttggctgtcttgacttgcacctgcttatatttgctccattttagcgtttcttttaccatatctttaaaccggttggcttcttttaacgtatcaagggacaaatcactttttaattgaaaaataagtgtatctcctttttcgcgaaggtccaccatatccatataagattgaaggggctttgtcatttcaggcagctgcacctgttcatatgtgttcaccatatcctgcaaatgatcatacccatcctctttttcaatgctaattggaaccacttgagaggtcgattcatctatgtatgcaatggtcatatacttttgctgctgcttataagaaacaacgtgtgagggcccatcagtctgcttgaccgcctctaatgtggcgttcacctgacttttgtcagcacttgaatccattttcatttgctgttgatgatcttgagcagccggctgaaataaatgaggggaaattaaaaacgccataaataaaaccacaacggttgcgaccgctggaccgatccatttggcacttttctttttctgcccgcttgccatcagcatcttctggtatatttgcttagatgaacggttgtcctccacctttggaagctgacttagtaacaccttgattcgttcttcgctccaatcggacctgttcgttttcattcactagctcctccttcaaaagctccatatgttttcggagcactttcaggcctcggtgctgagttgttttgactttgctttccgagaactttagcgcctttgccgtctccatgattgagtagccctggataaatcttaaaatgatgacagctcgttgatcaatcgtgcactgatcaagtgcggcatagatttcttttacattttcatcctgcacagccagttcgtctgggagcaagtctgggtcctttacatcctgcttatcccaatcaaacgtgccgagtacccgttgtctaatggtttgctgtttgcgaaaccaatcaattgccacatgccttgcaatcgaaaacagccatgttttctcgctgcttcttccttcaaaagttttatatgagtgaagtacccggatgtaaacctcctgaacgagatcctctgcctgatttttatctttaaccatataaaataaaaactggtacaaatcttgatggtacgaatcatatattttttgaaaggtttcatgcataggaaacccctccgttcacttatttttgtcgagtgactcttacaaaacgttacattacaactttatgacaaatatattacaagttcgacaattttgaaagggctttttgtttaacttctccttaaaaatatgaaaataaaaaaaacacttctttttctttcgaaaagaagtgtttctcatgtaacaagattcttcgtcaggattagacgagttcctgcttttttctcggaatataaaaggtaaagtgtgtacctgtacccgctttgctatgtgcatgaatggagccttgatgcgcttctacgatgttcttcacaattgcaagaccaagtccagtaccagaacgccctcttgttcttgccttatccgctttatagaaacgttcgaaaataaatggcagatcctcttctgggattccgcttcctgaatcttttacatccattttcagaccgctttccaccgattgaaccgagaagtgaacctctccgccctctggtgtatgacgaatggcgttatcaataagattcgtaaacacctgctcaatcttatctggatcgagtacaaagtggggttcatccacttgaatgtcatatgtgagatcaacttgcttttcttttgcaataccgagaaatttgcggtaaatcttctcgatcagctcttctgtatccgttgattcaagattcagtgtaatatggccagcttccattctcgctaggtctagaagatcgttcacaagacgtcccattcgaagcgattcgtcgtaaataatttgcgcaatctctttcttttcctcttctgagccagcaatatcatctacaatcgcctcactatatccttgcagcatagcaattggagtacgaagttcatgactgacattggcaatgaagtcttttctcagcttatcaagtcttcgttcctctgtcatatcacgaaggaccgcaactgctcccctaacgtcctgctgattataaagcggagacatgagaagaacccaagtacgcccttgcagcgtgacttcgatcatttgctctttctccgtgctgacggctgtatgaaacagttctcgcgcttctggaggcagttcatctccatctttgatcttcatattttgctcgtaataccatgcctgcaagaatcgttctgcaggtggattcgtcatgaggatcgttccatcaatattgatggtgatgacaccatcagccatactgcttaaaatattggacagatgctctttttcttgatttaaggctgtgatatgaaatttaagctgcttgcccatttgattaaaggcgatggccagttctccaatttcgtcttgcgttaatataggaatctttgtatcaaatttccctttcgccagatcctgtgctccctctttcatctttctaagaggataggtgacacgagttgataagaagaaagcgaatatagtggtcagaacaatggcaattccggctgctaggaagatataacgcgtcgtatgttttgttgtttgctctacagcgagtaatgattgagaaagaaagaccatgccttttttcccgtttgcctcaaatggaacaccgacgacaattcgttcatctttatgattgcctgcatttggttctgcacgtttactgatttttttacgattttttagcgcttgattcaaatcactgtctgcttcaatttgtttctttgtaatcgcaggaagcttcccgtctttttcagacgagtaccactctagcccgtcctcttggataatcgcaatactcgtcaatttgtcagcaagctctgatgtaatcgaccttgcaagtgattgatcgtcatggctttctaagatgaccgccactttatttgccatttgcgttaaatctgactttgcttcttctacatggtaattttcaatgaactctaaaagaagcacggttaaaatagataaaacgatgaggacgaggaagagaatggttaaccatagctttccaacgacacttttccacagtttcattcagcgccgacctcaaatttgtacccgacaccccataccgtcacgatttttttcgcagcttctggtgacactttattcagcttttcccgtagtcgtttgacgtgggtatcaactgttctcaagtctccaaagaattcatactgccatacttcttttaacagcttctctctgtcataaaccttatccggtgttttcgcaaggaaatataaaagctcatattccttcggcgtgagactgacttctttgccatcagctgtcactctatgcgcatcgtggtcaattgaaagatgagaaaacacaagtacatcttttgttgttgtcccagtattgagataagacgtttgagaagatcttctgagcaatgccttcacacgtaaaacaacttcacgcgggctaaaaggtttgacgatgtagtcatccgtacctgcttcaaacccttgcacgcggttggcctcttctccttttgccgtcagcataatgattggagttgcttttttgtctcgaatttgattacacacttcgatcccatctgtgccaggcatcattaaatcgagcaaaatgaggtcataatctatttggagtcctttttgaatggcctcatctccattttcagcttcatcaatttcataattttcacgttctaaatacatttttaaaaggcggcgaattcttgcctcatcatctacgactaatattttcgtttgagttgtgtgttccattagacaatcctcctgctttctccgttgttacattcattttaacaaaaagccgaatcgattcataaaaagttggcctttttcatgtgattacgcgtaagaatgaagccctgcaatcacgagattgacaaagatgagattaaacataatgatggcgaatccgatgacagctaaccaagcggacttttcgccatgccagcccctggataagcgaagatgaaggtaggctgcataaaagagaaacgtaatcaatgcccatacttccttcgggtcccagccccagaaccgagtccatgcaatttgcgcccagatcattgcaaaaatgagtccgcctaacgcaaatacagggaaaccaatggaaacagctctgtatccaatttcatcgactaaatctaggttcacctgtttcacgagcggttgaagtagagcgctcagtcgtttgcgaatgatcaaccgaatcagcccatacaagatcagccccgtgccgaatgaccataacaccgtattgacctttcttcctgaaaaaacaggcggcaaatcaacaaacggttccaaacgatcttgcgtcacaagctctcctttatgaggtccaactagagctggcagctcatagaccatcacactttcctctttatttttatcgacccaattaaatttcgcttcgtatcctgtcattctaaagatggacgtgactgcgataaatgcaagtgtcacaacaatcataaacatgacaagctctaaaccaaatgtcttcttacctggtttagtttgatcgacatgctttaataagaagatgacacccgccacaaagctgatcgctaaaatagcttgccctagtgctgctgttgtcacgtgaatataaagccaattactttgtaatgaaggaattagcggtgatatatcagatgggaacatgcttgcataggcaataatcaataaagcgattggaagtgtaaataaaccaagtaccgacacttgatacacaaaatataaaatgatgaatgcgagcacaagcatcatgccaaaagccgttgtgaattcaaacaaattactgactggtgcatgaccagacgccatccatcttgaaataaagtagccaaattgacttaaaaaaccgatgatggtaagcgtaataccgataagtgccgccttatttttgcgcggtccatcaactttcttttttcctttaatggcaccaccaaaaaaaggaactgccgctaaatacaatagaaaagctgcaaataacaggttttcactgactgctgccatctaatccttcccccttgcttttgctgatacttgttgtatcaggcagttctttttgatcaactggctgtttgatgccactgtcacttaggatcacgccaagatcagactttaagccaaaccagtttttgtttgtgtgtcctgccacgaatacttttccatcctttgcagacagccaaattcttctatgctgccaatacatcccctgcacgacaccaatcatgaagatgatcccgcctacaatgagcaccccaagagttaaatcttttctcaccgtcaatcccgtgacgtttttggtttccactcgatcaaacttcattttatataggttgttatcagaaccctcaactgtctcttgaatcgccacaaagcttttttcacctttaggcttttcaggagaaaccatttcaaacacgaaagcaggattattcggattccttgttttcgtacttggcgttccatcatcgtcaaaataaaaatcagggagatagctcatcactttgactttgtaaccgctaccaagatcatattctgacttaggctccagcagattaatcttcactgttccgaaagatttttcagtatctttacgaatcagctgaaagaccatttgatcgagttcattttgtttaaaatccacttgatataatgagaaatgatcaaacttgagcggttcgttcactttaatatcgtgttctgatacctgcttcagcttgggcttttcaccaaacacaacttccccttcacgtttgtataaagtggcatcggttttataacttttcactacttgaccgtcgccagctctttcaatcgcattctcaaacacttctttttcattttcagtttcatagcggtcaattgaaaacgcattatttttcaaaaaatattgaccatctgtgcctggaattggggcagtttcaccctctctaacccacagcgtttcatccacatacatgcctgggacaaaccggagcattgatccaatgagaaagatgattaatccaatgtgattgacgtaagggccccagcgtgagaagcggcctttttccgctaaaatatgtccgttttcttctcgtactcggtaacgcttttgtttcattgctttcatgatgccttcatatgtatgctgatctaacgttttgtctgtctcactgaacagacgctgtcttctcataaagccttcttttttgataaccccttggtttttgagtgctcgataaagaggaataacccggtcgagactgcaaatgacaagggagattccgatggatgcaactagagctaaaaaccaccaagaattataaagatcatggaatccaagtgtgtaatacagcttgccaaacgacccatattgctcttcatagtaagtggaagcagatgcacctggcggaataaatcgctcctgcggaaaaatcgttcctaatgaggaagcaagcagtgtaatgacaatcagccacacacccaccttaacggaagaaaaaaagttccatactttatcaacaatcgttttgttgtatgtttgcgagcgcctcgcactgccgtcgtatctcatatcaagcagctttgaagagtttttctctttagccgcaataggattcccgcaggattcacataaaacagtaccgattggattaatatgtccacactcgcattttacctctttcattctatgacccctttggtttaatcaaattcatatattcatagacattgcgttctgtcatggttccctttatgactttgattaccttgccttcaggattaattaaaaatgtggttggcagcggcgtaatatcatatgcctctgtcacttgacgatctttgtccatggcaacaggaaaattcacgccataggattccataaaatttttcacggcaatattggattccccaacattcactgcaacaatttccacaccgcgatccttgaacacttcatattgatttgccatgtaagggaattcttgtttacacggaccacaccaggtcccccaaaaattaagaaagacgcctttgccttttaagtcctttagttcaatccgttccccatccacagattgaaggacaaagtttggcgcaatagatccttctttcacccgatcctgtttggcaaatactgagttatacatggtataacataatgcagcaagcatcacgaggagaatgcccgtccgtatgaaaaaccgtctttttttcatctgaagtaccccttccccatagacattcaggtaaattatagcattctccttcttttgatgcttcttcattttttgaagtttatgtgaaaattaaaaagcactttttccgtgatccgcaatcgctctcagacgcttcacttcatgtggagacaattctctgcggtctcctggtctcatgccttcaatatgaaggaacgcatattgctctctttttagctttagcacatcatgaccgatcgcttcaaacatgcggcgcacttgtctgtttctgccttcatgaatggttaattgaacaatagatgtctgctttcgtttatcaatcgaaagcattttcgcacgggcaggtgcagtttttttatgatctaacataatccctttttctagctttctcagcaattcctttgatgggattccttttagcttcgctgcatatgttttatcaatttcgtatttcggatgcatgagcttatgggcaaattccccgtcatttgtaattaaaatcaaaccgctcgtatcataatctaaccggccgattggataaaggcgctgcgggacgtcatcaaagaaatctgtgaccaccttacgtcctttatcatcctcggcagctgaaatgacgccgcgcggtttataaagcataaagtaaaccggttcttctctttcaagctttaatccgttgacttcaattttatctgaagagcccacttttactccgagctctgtcactgtttgaccattaacggtaactcgtccttctttaattaattcttctgcctttcgtcttgaagcgacgccggcatgtgcaattactttctgtaaacgttccattttgtctttcacctcatgtactatcttacttgcttgacttaaaacaaacaagcattcgtggaaaaataagcgattcgtctgtttaatttcagctaaaaagcaatttcccatccattgaaagacaaaaaagcgcctctttaggcgccgctaaataacaaactgacaatgatgacagatgcaatgattccaatgaggtccgctaacagacctactttcagcgcatctcccatttttttaataccgactgccccaaaatagaccgttaaaacgtagagagtggtatcagttgacccttgcatgacagctgcgagctgtccgataaaagaatctggtccatatgtcgcaatgaggtctgatgtcatcccaagtgcagctgtgccagatatcggacgaataaacgcaagcggcactacttctgccggaaagccgatcgctgtaaacacgggttttaacaggcccatgacaaattcaagtgcaccagacgcgcggaatatcgtaatggccacgagcatgccgactaaataaggaatgattgaaaaggcaatttgaataccctctttcccgccctcgacaaatgtttcataggtcggtacctttttaatggttcccgcaattaaaattcctgcgatgatcagtgggatcaaagcaagtgacagccagttaataaatgacacgagatcacccccgcctgcttctgcgatagtggaaatagcgatcaatgagaatggcaccaatgcctgaaatgagtgtcgccaaaatggttggccctacaatgtctgttggctgatctgcaccataggtcattctaatcgcaatgacggttgttggcacgagtgtgatagaggatgtgttgaccgctaaaaatgtaatcatggaccggcttgcttcatttttcccgccgtttaatgctttcatctgctccatcgccttaatcccaagcggtgtggcggcattcccgagaccaaagaaattcgccatcagattggacaaaatatatcccatcgcaggatggttaggcggaatatcaggaaatagctttgaaataaagggacggcacaatttactaaagaaatttaacaaacctgcctcttctgcaatcttcatcagcccgagccaaaaaacgaggacactaatcagaccaattgaaatggtcactgcttcctttgatcccttaaatacagcttcgtttacttcctccatcgttccgttgaacatcgcatacacaagaccgatgacagagaggaatacccaaattagattgaccatgaagatccgcctatagatgtctgaaagacagacttaaacatttcttgaaagcttttttgtggcattcgatttcgtttattttcataaaaaatcggtacttgctcgatcacctgaccatctagtaaaaacgtcattttccctacaacatccgggatggcttcggcgttttttttccactttttttgaggagtaagcatttccgtttcaatttctactagctttttctcatcttcatttaaaaaatagtccacatcacgtttgataaatgcctttttttcgtaaaaggttccctttaatgaagcgagtcttcctttttcagcaagtacgtacgttttatagtgatcaaatgcatattcaaacatagagatatgatccttccaatcatctggcgcattaatggtcacagcgatcagcgccgcatctccttttgcggctgtagagacaagtgtgcgtttcgcaagcttcgtatatcccgttttccctccagtagaatattgatataaaccagtaaggagcttgtttttatttttccaatagccctccatcgtttttgctttatagaaagtcgtgcccgcaattttttgatattgtttatgctccatggcgtattttgttaagatggccatgtcataggctgatgaataatgatgtttatgatcatccagtccatgcggattttgaaaattcgtattctccattcctagttcagatgctttttgattcatcataaaaataaatccttctaagctgccgcccacatgctctgcaatggcaacagctgcatcatttccagaacgcagcataagcccgtatgtcaagtcttctaggctcaccttctgcccttcttttaaataaatcgatgagccctctgcttgaatcgcgcgctttgatattttgacggtgtctttcattttccctgattcaatggctaataccgccgtcattatttttgtaatactggcgattcttcttttttcatgctcgtcctttccaaataggactctgcctgactgtccatctattaaaatggcgcttcttgcactcaccgataatgacatatctgctttggcatgtgaggaaaagggcagtaagagtgtaaatagaagaaggactgctgttccaatttttaaatagggcatgttcattcacgtccttgtccgttttgtacaagtgtatgcgcggctgaaaaagttatgatgcctcgtccataaaaaaaagcgtctctatatgtagagacgctttttcctcttgctataccattttcatttgctgatgagatgtcgtatattctagctcttctctcatcgctaaaaaatctttttctaatgaagaaaataatcgtttgatctcagcggatacttcatggtggaaaacaatgctgctctttcctgtatacgcggaacggctgtcttcataccatgtatcctttttcggcgtgaaaaactcttcaatacatcgatgataaatacggtgaagcgtctgctgcgcggcttgctgcgggaatgtctgctgctggctgattttcctgcaaactgccgctgcatcctcactgtacactgcaagcttccgtaatgtattcaatatgtcacaataataggcttccgcttcagggtttaatcgtttcatacttgataaggtagcttcattcagaaaaccattcatttcagttgcaacctttgataaaaagacgcctgcttgatcaacttgagcctttacattcatatgtgccatttgttttgtgtttaccttcccctcatggctttatgaccattttatctgacatcaatagatgttagacctaaaatcttttttatattttatcatacctttttcattcttttgaactattttatctcttcaaatgtttgattgaagttttcaaaaaatagatcagcttcttcttgtacaccatctgcttctacattctctggaagcggcggtaattcatccaatgcctttaagccaaactgctctaaaaaggtcggtgttgtcccataaagaattgctcgcccaggtccatcggcacgtccaacttcacagagcagcgctttggctactaaactatgaagcacccgctctgatttgactcctctaatttcttctacctcactgcgtgtgatcggctgtttataagaaacgattgcgagtacttcaagggctgcttgagacaaacctttggatggggtctcgactaattttttcaaataaatgctgtattcttttttcgtcagcagcatataagaatctgcatattcaatgagctcaattcctcgttcttgtttttgatattcttcctttacggcagacatcatgtcgagtaacgctgcctcttctacttcaagaacagacatgagctgtttttttgttaagccttcgtcacctgctgcataaagcagcgcttctatgatggctttccaattcacgatatcaagcgtcatgaatcgtttcactccctattatataaatgtcttcaaagtttccttcctgctctaacatgatttgatgacttttcatcaattcaagaacagcaagaaacgtcacgacaaggtgctccttttgatcatgttgaaatagagtcatgaaattggtgcgctttttcgtttttcttaaatggttcataatctcattcattttgtcttcaatcggaatttcttgtcttgtaatcctagatggtgccggtttcgttattttttttcggttcaataccttttggaacgcacctaacatatcatacaccgtgacatgcaagtttgtgtccttcgcttccgattcttttgcaaattcgcttaaatcactcgggggttttgtaaaggcattttgcctttcttcctcgcgttcctttagttcttgtgctgcatctttatactttcggtattcaatgagtttaccaatcagttcttctcgagggtcctcttcttcttcaagcaggtcttcatcaaatagctcttcctcttgtttcggaaggagcattctgcttttaatgctcaggagggttgcagccatcaccaaatattcacttgccacatcaagttcaagctccctcatggtgtggacatataataaatactgctccgtaattttagcaacgggaatatcataaatatcaatttccaaccggttgattaaatgtaaaagcaagtccaaaggaccttcaaacgaatctattttcacctgatattccagcattttttctcaccatttctactgtcttctaagtaccgtttcaccggctaacctttagtataagacaggataaagctctcgtccaatataatttcgaccatgatgtcctaggcaaaataagaaaaacattggattcgcccataccactcagggcatttatacatagaataccattgtaaacagaactgatgaaaaaggaggccgtatcattatgggagatggctataactttggcggaggtttcgcgcttattgtcgtgcttttcatcttgctgatcatcgttggcgcggcttgggtttattaaagaaacagagcgtcctttcacgaagggcgctctttcttcttttcttttcaatatgttagactgaaagtggaaaaggagatgaccactgtgtatcctgaagcgtacgtggcttttttacatgaatttcatacgacaagagattattttgagtgtcatgaaattcttgaggaatattggaaagaagacccgcctgagcagcgcaaagaatattgggttggctttattcagcttgccgttgctttgtatcatcaaagacggggaaatggaaaaggagcaaaacggctcatttcaaatagcctccacttgctggaagcaaaccggccggtattatcgaacctcggtctggatgatgaggcgtttctcatacttctgagaacgctgaagaagaaaatggctgaagatatgtcatacgaaagtgtgatgctcccgattaaagatgaagcgcttctgtttctatgccaagaaatggctcaaaaagaaggactgacctttggccaggagagcaacttatcccacacatttttgatcgaaaaacatagactgcgcgaccggacagatgtattacttgaacgaaaaaagcaaatcgaacgtaaaaaaagcagaggactgtagcctctgcttttacatgtgtgatatttagtttgtttcgctgtgacacttatgaaagaagccttgcgttaattcatttggaatgagtgttttggttttgaatacctcttccacggctaataccatttccttgccgattccttgatcacgatgggatggattcacactaatatgctcgatttgtacttggtcgtctgttttcaacacaccaatggcacctacgatatcctcgccatctttccaaaggaacagctgccgattttcatccatttcataagacttcatcgtctgctgaagctgtttgacgtctttctcacccggcatgaaggaaagtagccccatggcaattttttcaaaagacctcttataacgaattaacatatatacccctcaatattcaaattatccttatgtccagcaaatgtctcacgaatcatttgctcatcacacattataaacatttttataccgtttttaaactctttttcactaaattaacgaaaggtacgattgagattcgccatttcaatggcagctgcagccgattcgctgcctttatttccagcttttgtgccggctctttcgatggcttgttcaatggattctgttgttagtacaccgaagataatcggtacacctgttgacatggcactttgagcaattcctttagcggcttcattacaaacataatcgtagtgagttgttgcgcccctgattacagttccaagtgtaatgacggcatcgtatttctctgtttcagctagtttttttgccatgtacggaatttcaaaagcacccggtacccacacaacatcaatatcgtcaccgtttgctccgtgtctgagcaatgtatcttctgctccgtcaagcagtttacttgtaataaagtcattaaatctcgcgacgacaattgcaaattttagtccttctgctactacatgcccttgtattgtattcatatgttgatcatccttttttgtgattttttattttgtttcgacagaagctgtttctttatgatttaaataggtctgtaatgcttctattgtcagcatttttaaaccgtgctgtttttggattttttttagttctggaacccgcgccattgagccatctacattcataatttcacatatgacacccgctggctctgaacctgccagtttcgcaagatctaccgctgcctctgtatgacctggtctttctagtacaccgccttcttttgcaatgagcggaaatacatgacctgggcgggcaaattcttctggtgttgcgtctttatttaacatggcaagcatggtcatagagcgctcaaaagcactaataccagtcgtcgttgtcacatgatcgatgctcacagtaaaagctgtatggtgtgcatctgtattttgttctaccattggatgcaggttcagatgtttagcaatcgacgcttgaaccggtgtacaaatgaggcctcttccatgtaaagccataaagttaatcacttcaggcgtggcatgctcagcaagtgccacaaaatctccttcgttttctctgtcttcatcatccacaacgataatgatttctccttcttttagagcgtttactgcttcttctactgaatgatacatacaatcgcctcctagaatccgtgctcttttaaaaatgatggggtcaatcgagatggctgcttttcgccttgttcttttgtgaaaaagcgatagatgtatttaccgatcatgtcacactctatattcacagtctctcccatagatttagtcgggaaaatagttccttcaagcgtatgaggaataatagagactgtgacgtgtgaatcttgcaaatcgaaaatggttaagctgacaccatctattgcgatcgaacccttttgcgtgagcatatctgtgagggtcttgtccatttctaaatcatagtaaatggcattacttttcttttctattcgggtaatgactgccgtcccgtcaacatggcctgagacaaaatgaccgccgaaccgtccattcgaggacatggcccgctctaaattcactggactgcctgatgtcagctgatccagtgatgtcgctttgaccgtctctggcatcacatctgctgcgaactgtgcttttgtaaagcttgtgactgtaagacatacaccattgatcgctatactgtctccaaggtgaacatcttctagcacacggctgcactgaatgacaattcccatggcatctgctgactttttgcttaatgactgaacggtgcctacttcttcaattatccccgtaaacatgtgatcctccctttcttttcatttgtatttctcacttttaaaaaaagcgatgttagggacatgtgatcgattgagcaccttcgtcgctttttatggtccatacaaggtagatgagggatcacctaataaacactgcatgccggtctattcactacatgtacatacagaaagccccggaaaaaattccggggctttggcttttttgcatcagaaataaaactatgatcaacaaatatttttcgttcatagctttttttatccttctcccatccagactttcactgtcggcttcagcttttcactgaatcaaccgttaataaattaacgggtcacgggctgtaaagcatttgctttattaccgtcggtcgggattttcaccctgccccgaaggatacaatcgatattcatctgtccttagaggatattataacgatccttgttggcaaatgcaacaatcaagatttttcacaaaaaaaagactccttataggaaaggagacttgttaattaacgacttttactacttttataagaccatctattcttttttcattactaaagtaggctttaatacgatcgcctttcttcaagtcggccacatcatcttcgaatttctttccattaaaaatgattttcgtgccgttttttgcttgaccgtaatattcatctccgtcaattttcgtaatggtatattcatagatggtataatctttatcattatttgttaagctctcaccaatggctgttggcacatcttcaattttcatgccattcatgtataaataacctacgcctaaaaaaagcagtaaaacaaataaaatggccattttcaatttaattttccccatatttagaacctccatcatctgcacttcgcctatttgtatgttttattccttcttttgatgaaataaaaccaaaaaagctgatttccattaatggttacttatataacgattgagatggacctttggttccaccttttcatcattacatatgttacgaatatgcgttctttattaagggggtctctttcctctttatcagttagcaaggcacacatcattgatgatcatcttttttcgagtgcgaataaatcttcctctaacaattgcgatctctgaacagcgatgtttcggctgtcacgaaccccttgattataatagtagcttccaagattttttgtgataaattctagtatattgatggctgctaattcaccaatttcttcttctcgttcttcggcaaaataacgctgaatggcaatcatcatttgatttttttcttcttttgttaatggtttcaaattatctcctgctttctttcagcatgaccacgcttttttgatttgtactgacaatgtggtgacacccacaaatacgaatgtttgttctcttatcatatcacaaaatcgaattttgtccatcactgacctaaaagaaaaagcgtatttttattttaatatggaaagtatcgtcgctacagaatgatctacaaatgaacgctctggacgagatttcatgagaacggtcagtcctatgaaagaaacgaccagtgtttgtgctaaagctttcgcattcaggctgcttttgagctcacccgagcgaataccttgaataattctttcttcgaaaatgacggaaagatacatctgatgctctcttgtcagaatttcaaatttctcttcgtgtggcgcaagttccactattgtattgatgcaaaaacaccctttactcggaccatctctatattcctcttctactaaatctgcaaataatgcatgaaatgcttccttgacagaaagattgttttgaagttttgttcgaatatgggcagcatgctgctttgtgtatttgcgtaatgcagcctcaaataattcctctttatctccaaacgctgagtataaacttggccgctgtattcccattttttcagtcaaatcgcttaatgtagtggccctataccctttttcccaaaaaagcaccattgcctcatccaacgctttttccttgtcaaattcccgttgtcgaaccatcagtaattcctcatttcaacattaaaatttcttcacaaagtcaggcatctattttttgatatcattctctatttgattaccaatcggtacattataattttattttatcgatgtacgattgtcaaattgccttcctctttcaaaatgaaagtattgactttaaaatgtttttttggttatccttaacaggaatcataatataccgatcggtatattatactttttagtacaaaaggagacgatgacatgcatggtgaaagaaaaaacactcccattgaacatcttgatttggaaacggctcatttacaaaacaaaccgaaacaagcgatgactcgctatatggctctgctgtttgcgtcagcctgcgggatggcagttgcaaacatatactttgcacaaccgttattagactctctcgcatccgagtttggtatcacctattcatccattggcatggtcattacgattactcaactttgttatgcactagggctgctactgatcgtaccacttggtgatctgtttaatcaaaggcggctcatcatggctcagatgctagtatccgtgttatctctgattctagtcggcatcgcccctactgccaccgtcctgttcatagggctggctgccgtcggcatgcttgctgtggtcactcaggtactcgtagcgttcgcagcgacatgggctgcccctgaagaacgaggccgtatcgtgggcttggttcaaagtggcattgtgattggtattcttttcgcacgaacgtttgctggtgtactaaccgatctcgctggctggaggtcagtctatctcgtgtctgccgttatgatgctcattataaccggcgtgttataccggtatctcccgcgtgctcacagcaagagagcgtctatatcctatatgaagctgctcgcttcaatgtttatattgttcagacaagaacgaatccttcgcatccgaggcatactgggttttctgatctttatcgtgtttggtacgttgtggacttcactcgtgctgcctctcagcagctcgccgcacaatctttcacatacggcgatcggtgcatttggtcttgccggagttgccggggcattaggcgctgcccgggctggaagccttgctgatcgaggcttaggacaattaacaacttttatagctcttgtcctattattcatttcatggttttttatatatttcacagaatattcactcattttattaatcatcggtattatcattcttgacctatctgtacaagctgtacatgtgaccaaccaaagcatgattttcacagtgctgcctgaggcgagaagccggctcactgctgcttatatgattttttactccatcggcagtgcgacaggttccattgcttccaccagcatatacgcaaacaatggctggagcggagtatgtttatttggcgcctctgtcagcgccattacccttttatattggttcatcacctaccgcctcacggaacaaataaccgtaaaatcagattgataataaaaaacaccgcgtttaagcggtgttttggattaaggattaagcatcgaaaacttcgactttttccattccttgaccttgttccatatctagaacagcctcgataccagatgttactttgccaaaaacagtgtgaactccgtttaagtgcggctgcgggtcatggacgataaagaattggctgccgcccgtgtctttaccagcatgcgccattgataatgaacctctttcgtgttgatgtggattcccttctgtttcacatttaattgtgtaaccaggaccaccagttccattaccgtttggatcgccgccttggcttacgaaaccagggatgacgcggtggaatttcagtccatcgtagaagccttcattcgctaatttttcaaagtttgctactgtaccaggagcagcctctgggtatagttcaaactcaagtttcttaccattcgttagttgtatgtatccttttttcgccatttttcacattctcctttcaggttaaacaacgctcattatagcacatttttggccatgttaaacatcctctgctctttgattgtgatttacctcttttcttaggattgatacaatagaagagcttgatccttttttcctattaaattggtgacagaatgagcaacatgtctttattttttggaaaaggaaaacatcttaaaaagaaaattgaaacgtcgaatcgatttgttacgtctatatgatggagtacatttctttacgtgtactcaaaagctgagtttctcttgaaagaggaaccctttcgacttgaaggaggtcaacatgtttaaaaaatcaatgcttagtatgatggcagcgctccttttcctcattggtgcgccaaaagtcagcttagcggatgcagctgtcggcgatgtcatcgtcacacttgggcaagacttaactccggctgatcgccagaaggtgcttgacgagttgaatccacctgaaaatgcgacaaaaattgaagtaaccaataaagaagagcatgaatatttaggaaagtatatcccccgttcttctatcggaacgagagcattatcatcttcatcgatcaccatagaaaaatcaggtgctggtctgactgtggatactcataacatcaagaccattacagatgaaatgtatttaaatgctttaatgacagccggtgtcaaggatgccaaagttgttgtgactgcaccgtttgaagtttctggtacagccgcactgacgggtttattaaaggcctatgaagtgtctagcgacaaagccattccagaagatgtgaagcaggtagcaaacgaagagcttgtgacaacgtctaaattgggtgactccatcgggaaagacaatgcttctgcccttatcgcaaaaattaaggatgacattgcgaaaaatggtgtccctaaaacaacaaaagaagtagaagaaaaagtggatcaggctgcttctgatttaaacttaaatctaacgcaagagcaaaaggatcaacttgtttcactattcgataaaatgaagaacatcaatatcgattggaaccaagtagggtctcaaatcgataaagcaaaagacaagattacgaaattcatagaatcagatgaagggaaaaacctacttcaaaagatttgggatttctttgtctccatttggaacgcgatcgtctctgtatttactggaggaaaataagtcatcataaaaagctgcctgtacatcaggcagctttttttaagtagatgattttacttttgattgataaggtaaatcaagtttgacaatatccgcatatgtttcgcgttcaaccacaagctgcgcttccccgtcttctacaaatacaacagccgggcgcgggatacggttataattatttgacatactgtagccgtaagctccggtacaaaagaccgctaataagtctccttgtgataactctggcagatcgatatcccaaataagcatatctccactttcacagcatttccctgcaatagaaaccgtttgatcatgcgattggctcattttgttggcacttgccgcttcatatttcgcttgatataaagctggacgaatgttgtcactcattcccccatctaccgcaacataatcgcgaatgccaggtacgtgttttgatgaaccgatcgtataaagcgttgtccctgcatctccaacaagagagcggcctggctcaatccaaatctccggcatatcaaactcatagcgtgtcacgttctcttttacagcttggataattttctcgacgtattctgtcgcaggaagtggttcatcttcttctgtataacggataccaaagccgccgcctaagtttaatacagtcgaaataaaaccaaatgattctctccattcatccagcttcaaaaagatcttgtctgctgcaaggacaaaaccagctgtatcaaatatttgtgaaccaatatggcaatgtacgcctaaaagttcgatcacttctgatccaagcacttgtttcaccgcttcatctgcttgtccattgtgaaggtcaaaaccgaatttggaatcctcttggccagttgtaatgtaatcatgcgtatgcgcttcgacacctggtgtgatacgtagcagcactttcaccttttttgacagctcttgaccaagctcttcaatgagtttcatttcgtaaaaattatctacgacgatacagccgatctcttgctctaacgccatttttaattcatctctgcttttattgttgccatggaaatgaattttttctaccggaaacccggcgcaaatggctgtgtgaagctccccgcctgatacgacatcaagagataatccttcttccttagcaagctgaaacattgcgatggaggaaaatgctttactcgcatacgctacctgcgcttttaactcttcttctataaatgctttttgaaagctttttgcacgctcccgtattaaagccacatcatatacataaagtggtgtcccatacgtttcagctaaagaaacggcatcaacaccaccaatttctaaatgaccgagttcattttgtctgcaagtgccgtgtaaatacaatgtcattccctctttctccgcctcggctgaaaaaagacagctgcgtgagctgcctttttgccgtttctcaaagttaaaaatacaatatcacaatcttcagccactttcaatgagcgttaagaatttggcggaatttttgatctgttttgagggtgaacaatgcttggccttacttttgagccaggaacagacgtccgaatcagcacttgccacaaagccttcccgttaaaaggaagaaatggccacatataaggcgtctgcaatgaacgaatggatgttaagtagatgagtaacaacgtaaaaccaatgatgagtccattcagcttaaagatcgccacgagcgctaatatgatgagtcgtacaatcttattggcgacactcagctcatagcttggggtagtaaatgtaccgattgccgctagtgagacgtataagatgacctctggtgtaaataaaccgacatcaatggcaatttgtccaattaaaacagccgcaatcagccccatggcggtcgacaaggcagttggcgtatgaatcgcagccatccttaaaaattccactccaaaatcagctagaaacacttgtaaaatcacgggaatatgggacggtttgttaaagccaatatagcttaaattatctggcagaagacttggttcaaggataaacagaaaccaaatcggtaaaagaaacgttgaacataaaatgcctaaaaagcgtacccatcttaggaacgtaccaactgcaggtgcttggcggtattcttctgcatgttgaacgtggtgaaaaatggtggttggcgtaatgatgacactaggagatgtatccgtgatgatgatgacatgcccttctagtatatggttagcggcgacatctggacgctcggtgtaacgtacaaggggaaagggattgtatccttgtttaataatgaattcttcaattgttttatcagacatcgtcagcccgtcgactttgattcctgacacttctttctctatgatatcgacaagatctgggtccgcaatatcttcaatgtagcaaacacatacatccgctttcgaacgttcgcctactttgagcattttgtatctcagtttttcatctcgcacccgtcttcgtatgagtgctgtattgacaataatgttttcaacaaaaccgtctcttgcaccccggacaaccttttctgtatccggctcctctggcattctgccaggatagcttctgacatcaatgataaatgcgtagttttcaccttcaactacaactgccacaagacccgacagcacttggtctaccgcttcatcaagtgtttcaacctttgagacctgctgattgacaagacgattctcaatcacacgggccatgtcatcagattcaggttcgttgtcattgatttcaactagctcttttaataagtagatgacatactgtgtgtcacatagtccatttacatagtaaagttggatttcctgatcgtgtatataaatttttcgcacgccaaggtcaaagctgagacccatcccgacattttctttaaagtaatcttcatttttcttcggatctcggtacacgttcaccttgtctttcttcatggaaaccactcctttctaaaattaattcaaccgctttcattgtaattggagatcctttgctcagatcatctttccgtcccattttgccaatatctccaattccaacaacaaacggaagatcgagcgaatcaagacaatacacggtatctccgctcattttatgaggttccatctcaggaagaccatgcttgtcgacaccgtattctgtcagttcaccctcccggtcaatggaaacatgaacctttgtccattcagcttgatgcgttttggatgcaacggcgatcgccccaatgacttcaatttcaggatgacgcgccacatgcttcatcgctatctcccctgttccttcacctgtcaggccagaatcatcaaacatgacaaacactggatcattcggcgtttttaaaatcatctgcacaagttcaggtcctgttcgtttgcttggatttccttttgagctggaaatacatcgcccaccgacatttttagcagcaagctcaatggttttggcagcatatatatctccgtctgtcactaaaatgactttccgtctttgcgccatattaggttatcctttcggtttaaagataagagcgataataaatgagaataaaatcgcagctgaaattccagcagaagttaattcaaaaataccgatcccgattccgatgaacccgtgtacatctgcctgatgcatcgctccatgaagcaagctatgcccaaagctgacgattggtacggttgcgcccgcacccgcaaattcaataaatttatcataaataccgaatccgtctaagatggtacccgccacaacaaaagtggtcatgacatgtgcaggcgtaagtttgagtatgtctagtaaaagctggccaatgacgcaaataagtccgcctgcaacaaaagcgataagataatccattagctctctcctcctgcacgctcaaatacgacaccgtgcgcaatggttggaatggtctctttttgctgaaccatcattggactaagaagcgctccggttgccacaacgagtactctttgcagattgcctgctttcatttcttgaaaaatgtgactaaatgtcacaacagctgaacaagcacagccgctcccaccagcgaatacattttgatcgggtgtatagatgattaaaccgcaatcatcatgcttcctcccaagctgaatgccttcttccttcagaagatcctttaaaattggtgaaccaataccagataaatcccctgttaaaatcagatcgtaatcgtccaccgttcttccaaggtcttctaaatgctgcttgatggtatctgccgctgccggagccatggccgatcccatgtcaaatggatctgtaattccaagatccatcaccctgcctactgtagcacttgtaatttgaattggagaggtctcctggctaataataacggccccgctcccagtgacggtacttgtggctgtatctggtttttgtccgccgtattcagttggattacgaaattggcgttctgccgttgcattatgactgcttgtcgctgcaatggctctattggcaaaaccgccatcaatgagtgctgacgcaatggcaaccgattccattgaggttgagcatgccccaaacaaacacagaaacgggattttcagttctcttgccacatagtttgctgtgacgttttgattgagtaaatctcctgccagcaatagatcaatatcgcttttttgtaaatttgcttttgataaagcactggatatcgcatcttccatcagttttctttcagccatttcccagttcttttgatcacaatgcatttcgtcatacgttttatcaattaaatgaccaattggcccttctttttctttcggccctgcggctgttccctccgcattgacgtaaagcttgtgctcaaaaacccaagattgtttacctgttagtttcatgtttcattcctcctacgaaaacatcttttccaagacgtatcgaatgatccctacgacatatgccgagacgacaccaaatacaatgacgttcccagcgagcttaaacatattggtggcaacccctaaaacaagcccttcacttttatgctcaagggcagcgcttgtcatactgtttgcaaatcctgtcaccggaacagccgatcccgctccagcaaactggccgattctatcgtaaataccgataccagttaatatagaagaaattaaaatgagagtcgccactgttgggttccctgctgttttttcattaaaatcaaaaaagtgaatatagaaattttgcagcccttcacctatagcacagatcaatccaccaacaagaaaagccttgatgcagttgaggacataaggaggtttaggctgatacgttttcaccttagatggatagttctcttttaaactcgacacggttgttccctccaaatttttaaatataaatcagccaatggaatagtgaaccaaatactttacctaagacaatggccatgagaagcaaaacaattttcccgtccattccaattcttttcgttaatataggaagcacatttaatacttcagtcagcgcagctgcaagcatgccgatgaaaatgccagccaatagaccgattgggagcgccagccatttggataaatgcaaatgcagttcgctcaaggttgcccagccgccaacgaccgccccggtgatgacagctgcctcgtatccttgtatgaagcgctgcgttttcgttaattgcattaaacgagggatgatgccaagtactgtgagaaatgccacaaatcctgctcctaccgttaaaccgccgccaagtccaactaacacgacaaaaagccacttaccgatcatggatatctttcattgtctctttattttctttaagggcgacataatgatcgagatcgagctgatatttaaacatctccacttcgagcggacttggttcttcatttaaacgctttttaaatacatgattgaaaaataaaatcatgccaaagcctagtccgaagctatatggaatttgcagtaaataaggatgctcaaccgtttgacctgtgatcatttcatatagacggatatgaacaagccgcatactgacatcctcgtggaaattcataatggcaagcgccgctccaacaaataataagagccacacaaacacaaataaaacgggagaaagctggcgtttgcctgtatcaatttcaacaatggcttcagcgcctccgacggtttgaatgtcgatatctggccatgattttttgatcgttttgaccacatgcatgatatcaagaacggcgatgtgacgatcttttttactgacatgatatatcggcatcttgctaagcttttgcacagcaaactcatcaccagtgatttgggcgatatcttctaaataaatgagctgatcattaccggtcttaatgcgatggcgcagccgaagaaagatttgtccgtccatccaagtcacttcctatacgatgggttaaaaatagtatgtggtgaaaaatggttctcataccgagagaacttgatttaccggtaattaccacacgaaaaaagccagccaaattggctagctctctttttgatccatttgcatttgaatttgctttaaaattttcttttcgagccgcgagacttgtacttgtgaaatgccgagtctctccgctacctcagattgtgtttgatctttataatatcttaagtacactatgagtttttctcgttcttctaattccttgatcgcttctttcagcgcgattttatcaaaccatctttcttctgaatgatcggcaatttgatcaagtaatgtaatcgggtccccgtcattttcatacaccgtttcatgaatcgacgacggcgttcggaccgcttcttgggcgaggacaacatcctctggtgtgatacctagatattcggctatttcctgaacggtcggcattctcccgtgagacttagacaattcatctcttgcccgccggattttatttccgagttcctttagtgaccggctaactttgactgttccatcatcccgaatgaatcgctggatttcaccaatgatcattgggacagcgtaggtcgaaaacttcacatcatatgacaaatcaaatttatcaacagattttagcagtccaatacagccaatttgaaacaaatcatctggttcatatcctctatttaaaaagcgctgaacaacggaccaaacaagacgcatgtttttttctacgaggaggtctcttgcttgctgatcaccgtcttggctttttttgatgagctctttaacttcatcatttgacagctgggctttttttgcttgcttttttacctccacatccatatgagcagctcctttaattacaaagcgctttgctttttgatagatgctttgttaatcggatggttgtgcccatttctggagatgagtcgatcatgacatcatccataaaattctccataatggtaaagcccattccagagcgttctaagtctggttttgtcgtgaaaagcggctgccttgcttcctcaagatctgtaatgcccataccttcgtcacggatggtgaggtacacaacatggtcatcaagtgtgacttcgatatgcaccttgccatctggattcccatcatagccatggataatggagtttgtcaccgcctctgacacaacggttttgatttctgttaattcatctaatgtcggatcaagctgggcgataaacgccgcgactgtcaccctcgcgaaggattcattttgacttaaagcagagaaggtcaggttcatttcattcctcatgatgccacccccagtgtttgcaatgccgtttgctctgaaggctccatacggatgattttaaataagccagacatatcaaataaccggttcactgccggcgaaatagcacagacgaccatttctccgccaagctgcttaatttctttatatcttcctaaaatcactccgagacctgagctgtccataaacgttaaatcagccaaattcagcacaatgtggcgaatgtcctctgtttccaaataattcgtcaccttttgtctcaatgtttctgcggagtgatgatcgagctctcctgttaatcgaatgcaaagtacgctctcttttacttgaaaatgaatatcaaggctcatctttttattcctccttgctctaatttcggataaagattgtttctcttttttatcaattaaatccttcaccatgacaaaactagtgaccattcgtcacatttagatgttcttttcttcttcctcatagcaaaaagactgcctgtttcagcagcctttcacattttatttccatttcacaaattcagccatcgctcgtttgaagaacgtccaaacgcccgctttttccattccttctttggcttgtacagggctttcatgcagcacttttccgtcttttttcaagacaatggttccaagttccgttccttttgagaatggggccgtaacatcctgagacagtttgatttcttttttaatctgatccacattttcgccttttttcgttaaaagggagattggttcagaggtgacaagctgaatttttttctttgtccctttgcttaccttgatttcggctacatcttgtcctcgtttgtaaagcgggtgtgtggtgtattgactaaatgcataatctaacattttgaccacttgagcgtttctgtctttcggtgtacttgcgccaaagacaacagcaatgacgcgcatgttaccttttttagcggttgcggttaaacaatatttggcttcacctgtaaaacctgttttcaacccatcgacacctggataaaatttaatcaaacggttcgtattcacaagccagaattttttatccgtgttttgacggagatagtcttcgtaaacacctgtgaatttggtgacttggtcatatttcaacagctcttttgccatttttgccatatcatgagctgtactgtaatggtctttttcaggaagtcctgttgggttttgaaagaccgtagaggtgaggccgagttcttttgcctttttgttcatttgctccacaaactgttcttcagatcctgcaatatgctctgccatggcaactgaagcatcatttccagacgcaattgcaatgcctttcagcatttctttcacagtcatttcttctccaggttcaaggaagatttgtgaccctcccattgaagctgcatagtcacttgttcttaccttgtcagtcattttcagttttccttgatcaatggcttccatgatgagaagcatcgtcatgattttggtcatacttgcgggtgccagcttttcctcgctgtttttgctgtaaagcacttttcccgtgtcacgttctattaagatggctgatttggcttcgtgcaccaattctgatgtttgtttttcttctggtttttcaatcttttcttttgctatcgctgatggtgaaaccattgagataaggatcattaaaataaacaatgcacatatatgacgtttcaagtggcagacctccattatcgtaatcctttctattttttcctcatcgaggctgttttattcagagatcgtatgattgccataaaaaaagccttctgtcggtaaacagaaggcctcttaaaacatactatgagagttgtttgacaatgtcttttactaattcaaggaaactcgttttcactttttccgttacttcaatgacttcatcatgagacagcggctgatctaaaatacctgatgccgcattagaaatgcatgaaatacctaacactttaattcctgcatgacgcgcaacaatcacctctgggaccgtcgacatgcctacagcatctgcgccaagtgttctgaggaaacgaacttcagccggtgtttcatatgaaggacctgtcatccctgcataaacaccttgctgtacagatatgcctaagcgctgagctgtttcttctgcaagtgcgagcaaatctttatcgtatggggcagacatatcagggaaacgaacgccttgactgtcatttggtccaattaatggattggtccccatcatattgatatgatctgtaatcagcatgagatcgcctggatgaaatgaagtattcacaccgccggctgcatttgtcacaatgcatgtctcaatgccaatttctttcatcacacgaactggaaacgtcacttgcttcatatcatatccttcatagaagtgaaaacgtccttgcatcgcacatacgacagtgcctttcagcgtcccgatgacgagctgtcctgcatgaccctctactgttgaaacagggaatccaggaatatcttcatatttcaatttgattggattttcaatctcatctgctaaaatgccaagccctgaacctaagattaatccaactgttggtacgtatgtcgatgcttgtttaatgtatgccgccgcttctgaaaactgtgctcccacgagatttccccctatttgagtttagataaaaagcttgtgccgtattttggcatcgttgttttgaaattgtctgcgaccgttgctccaagatcagcaaaggtttttgaagttggcagttcatttgctccttgatgctttttgctgtaagcaatgagcggaacgtattctcttgtatgatctgttccgtgatgtactgggtcatttccatgatctgctgtaatcactaaaagatcatcctcttttaacaggtcaaacacttcaggaagacgggcgtcaaattcctctagtgcttttccgtaaccctctggatctcttctatgtccataaagggcatcaaaatcaacaaggtttaaaaagctgagtcctgtaaagtctgctttaagtgtatcgaccaacttgtccattccgtccatgttcgactttgttctgagagaagaggtgattccttcgccatcataaatatcagagattttgccgatcgcaatcacatcgagcccatcatctttcatctcattcatcactgttcggtcaaatggttttaaagcatagtcatgacggtttggtgttctgacaaacgcaccaggctccccgacaaatggacgagcgataatgcggccaaccatatatttttcatctaatgtgagctcacgtgcaatttcacaaatacgataaagttcatctaatggcaccacttcttcgtgcgcagcaatttgcagcacagaatccgcagatgtataaacgattagatcgcctgttttcatgtgctcttcgccaagctcgtctaaaatttcagtaccagacgcaggtttatttccaataatgcctctgcctgttttttcttttagttcatttagtagttcatctgggaatccgtctggaaaaactctgaacggtgtgtctatgtaaagacccattatttcccagtgtccagtcattgtatctttcccatttgatgcctcttgcatttttccataatacgcaagtggtttctcatccgctggaattcctttgatttctttaatatgactcagcccaagcttcgccatatttggcatatgaagcccgttcattttttcagcaatatgtcctagtgtatctgcacctacatcattaaattcagcagcatcaggtgcttccccaattcctactgaatccattacgacgaggaaaatgcgtttatactgataatcaggcattaaaaagcgcctccttcaatattcttgtcttttaacctttcaaaaagagaggtctgacatctcaagtataaaccgtttacaagccggttgacaaccataaacggtgcaaacatgaaaaagcatgacacacgttcaccgtgccatgctttacttatgcccttggatggaatttgtgatacacatctttcaatcttgttttcgtcacatgtgtataaatttgtgttgtcgagatatcagcatgcccgagcatctcctgcacagctcttaggtcggcaccgttttcaagcagatgtgttgcaaatgaatgcctgagtgtatggggtgtgagttccttttgaatccctgcttcgagagctctttttttcaaattcttccagaaaccttgccgcgacatttttttcccgtgatgattgaggaataaggcatctgccggctgtttttttaacagcttgcttcttcccttttcgagatattcttcaatcgcacttgcagctgcttcaccaattggcacaatccgctcttttcttcctttaccgaaacaacggataaagcccattgtgaggtgtacatcggcaagggtcaaatccagcatttcactgacgcgaatgcctgttgcatataagagttcgagcatcgctttgtcacggtagtcaaatggagtgtgctgatttggtgtatcaagcaatttttcgacttcccctagtgatagaactttcggtaatttccgctctgttttttgcgtttcaatgttccatgacggatcatctgtggtcactttttcccggagcagaaattggtggaaggatcggatcgaggagagatgccgcactgacgttttgctcgatttcccttcctcttttagcttttttaaataatgaatgatatgcaggcgcgtgacatcttttatatccgtcagctgctcatgtgtcattaaaaaagacaagtagttctgtaaatctcgtttataagaaacaatggtattttcagagagtcctctctctactgtcataaaatgaataaagtcggataattgatcgttcaatgatttctactccccgttttgataaaaataaatcaatcggtcttgccagttgtcttgattcggctgatccatttccatcactttaattgctgcaccctctggtttatcataacgatggtagctttcatattctgaatttatccatatcatagcataatagaacaggacggtaaaaccagtgaacaagataaataccttcatcacttcacctgttgttttgagccattttcgcatgattctcatgtcctttctcagcttctcattacttcagcatatgccaggtgggacaaggaatatacagcgaaaatgcaaaaaacctcttcatcttaaatgaaaaggttccaattcggattaattgccggattcatcatcatgacaccggtggcaaataccatggaatgtcaatctatgatccttaattttaaatttccagtcacgttcaataatctcttcaacatcttctaataaatcatcttctatctcatcgactgtcccgcattccatgcagacaagatgatgatggaagtgagcggctccttctttgcgaagatcatatcgagaaacgccgtctccaaagttaattttatcaacaactttcagttcagttagcaattctaacgttcgataaacagtagcaagaccaatttcaggagacttctcttttacgaggaggtatacatcttctgcacttaaatggtcttcttcattctcaagcagtactcttactgttgcttcacgctgtggcgtgagcttatagctggaagaatgaagctgtttcttaattcgatcaatccgattttccattgactttccctcctacgccacattacttgaccattatatcaaatgatgtgctgggagccaactataatcattttaaattgataaataaattgattattacttaataacaattataaaatcatgagaaaagaacacctgccagctttttcatgagcatgaaggagacgtacgattcaaaaaaggacgaaagtgcagcaagtgctaaaatcatcagtagaacagatgcataccgggcgaaccactgcacaggtgcttgactgatggtttttttcataaacagctgcccaatgagacggatggaaaacgcaatcgcacatgtcccaatcactaaataggctggaataagtaatatgttttgcggaagaaccgatacgaacgaaaggaaaaagccactcagccccatttgatttactagaaaaccaactgtaaacccaacaacaattccttttaaaaagatcatgagaaagatgagcggcaggccaatgatagatattcctagtatccacataagacctaaatatttcatgtgatgcaagaagctttgcaaaaacatttcttttgattctgcagctttctcatttgtcagctgaccaaaaaattgatttaaataatagaataaatcctctttctgactaattgtcatactattgacgatgatggccccaaagatcacgcccattaaaaagagtacagagacaaacaaataaattgatagatggtcttttacgtgctgaagaagatgttccttccaagactttttccgcatgcgtcttcctcccaaatagtaaaggttactagattctatgagagagattacgaaacatgacagttttattgaaagaaaaaagagagagcagcctaacactgctctctcttctcatttatcgtgcggctttttgtacgttcacaagcccagcaccatagtaaaaagggtctccaagctgtgcagccgtttttgaaagtctctcgcgcacttcatcgtttgtcagattcggatgttttgatagaatgacagccgcagctcctgctacatgcggtgatgccatggatgttccgctcttgtagccatattcattatgaggaatagtgctgagcgttgaaacgcccggtgctgaaacttccacttcttcgccgacagaagaatcaaaggctctttgttttctttggtcaacagaagcaaccgctattactgagctgtatttggctggataatcaaccgtgttgagagagccataacttcctgcattcccagcagaagccacaatgagaatacccttgtcatatgctcgatctaccgcttctttcagcgcttcagattcacttgctccacccatactaatattgatgatatccatgtcattctcaatggcccattcaattcctttaatgatccagctatagtagccgtcaccattttcatctgccaccttgaccgcatagatagaagcttttggcgcaacaccaacgacacctaccttattatctaacgctgcaattgtgcccgccacatgcgtcccatgttcatgcgggtcaacaagcggatctgactctgttggaacaaagctgactcccccagtgacatgtagatcttcatgtttgccatcaatgccgctgtcaagaacagctactttgacattttgtccagcgtatccccgtttatgtaccttttgtgctttgatgcttttgatgccatatggaatcgtttgaccgtttgtttttgccttttggtcctcctcaatgaaggtcacttcttttgcccgatttagtttctctttcgatgcctcattcaaagaaactttcatcatatctatttgctctatggattcttttacatgtccaccagctttttcaacaagctgtttttgtgtatgatcttgaacggaagaagaaaagccgatcatgtactcttttttcgcttgctcctttgcagaaatatgtgaggcgccgaacgtgaccgatgccagcatcatacttgccatacaaagccctgctccaattgacttgatgttcacaatactcactctccctttcatctttttgtcatttaactacattttcagacaaaaagaaacgatcgtttgtcctatttttaaaaatttttccatttgaactggttgtcacaaaaaagcaaaataaaaatgcttatgatcctcttgatagtgatcataagcattccttcttttatgtttattcatcatgtgttgcaaggcttcttgttttgtttttgtctttctttcatgtgtactaaagtgcggaatgtttcctctcgacagttccgggtttcggctgtgctgcctttcaatatgttctcgttttttctttgcattgctttttcccatttggcaaaacccctttcgttgacgttatgatacacgatgtgacataaaaaagatagacgtatacacgcctatctttctgttttcaccatatcaagatgcggaattccatcttcctcataacaatcagaaacggccttaaatccaaaggattcgtaaaacgacttcaagtaggcctgcgcctgaattttgacacttgtttcacctaattcactcagcttttccaaagccttgctgagcagcatttttccatagcccttttttcggcctgcttgcgtcacaagaacgcggccaatggatgcctcttcgtatatgattccactttggaaaattcggcaataagccacaatcgtgccgtcctcttttgccatcagatgaagcgcttcttggtcccgttgatcaatttcagggtaagggcatgtttgttcaacaacaaatacattgactctttccattaagattaggtaaagatcctcttttgtcaattcttcaaacgttacacatgtccagttaacttgattcatgattgatatccaccttaccgtacacgccgcccccgccagcgatcagttcgacttcaccttttcttgctttgatgatgtaattggctgttttttctggcaggacagcttttagttcttgttctgtagcttgatgaaggatattcatctctgtgtgaaacacggcttttagcttctccagcgttttggctccaacacccggaataaattgaagcggaagctggtgaacataaggaggtcttgttccattgtcactttcttggtcggcaagctcctttaaacgctcactcactccttttgtcatccgtgtatgtccgcatgcgtggcacttttcttgatctagcgcgtgaggtcttactccgcacttctcgcaggttgtatgatagtacttcccaagccgcggggcgagcccataatttcctgtgatggctctcccctctttcccttcaagggctagtttaaattcggcaaaagaggcatgatccatgcggatttttgtatattctcgcgcgattttccctaaagaatgagcgtctgaattcgttaaaaaggggtaacggttcagttcgcttaactgggacgccattgacgtatcacagctaagtcctagttcaacagcatcaatgaggtccggatcgaatacttccgttaaagacgtgctgactcctttgccaaataagcttttatgcggggtgaaaatatgagcaggaataaataagcctcctagctccttgaccttatgctgcagtgttttcccatccacatagaggcgctgtgaacttaaatgcacatttttcatatgaagcgcgagccatgcggagaactcagtcattttgcgcagtgtgggcataaatgcaagcacgtgaatcggaccttttgaatggttatcgttaatttctaattcgctgcctaaaagcaggacggtctgtccaaatgagagaccgccatcacttagttcagtgtacttgccttcctctacaccttctattaattcttctagaacttctggagattgtgcatcaatcacaccaatcatccccatccctttactttgcgttgcttcaatgagaatttggtcaatagtcagtgaccttgcacctgtaattttaacagctctgcctgttcttgttctgccaatatgaatatggatgtctgcaaaaaactccctcattttgttgacttaagtacctcttgcagttgtaagtactgaatggcataggctgtttttgcatcataaatatgctgcttttcaacgaggtgcaaggcttcttctaatgaaacttccatcacttcaacaaattcatcttcgtccagctctcttttttcttcaagcggaactagctgatctgcaagatacatgtggacaatttcatctgcaaaacctggtgatgtataaaaggccgtcagcttttgaagcttctgagtggtgtatcctgtttcttcttctaattctcgcagtgctgtatgtgccggctcttcccctggctctaatttaccagccggaatttcaacgatggctctctctagtgctttacggtattgcttgaccaagatgattttattttcgtctgtccgagcaatgacggctactgcaccaggatgtttgatgatttcgcgtttgccttgttttccgtttggcaattctacatcttcaagaaccaaatcaatgatttttccgttgtataattctttagtcgataatgttttttcttcaaagtccttcaattttgtcagctcctcgttctactttcactttttacttcattcattttaacatagatgatttaagagaagcgaaatgcggacgcttgcttcaatgcgccacttgaagtcacctagcttgaattccagatttttttcacttaatgtgaaggaataggagtgtgatggaattgaaaaaaagacgaattggtacatcggatcttttggtgagcgaagcggctctaggatgtatgtccctaggaacagaaaaaggaaaagcgttctctttactagatgaagcgattgatcttggaattaactatttggatacagccgatttatatgattttggaacaaatgaggaaattgtcggggaagcgattaaaaacaggcggcaagatttaattttggccacaaaaggcgggaaccgctttgaaaaaggtaaatccggctggaactgggacccttcaaaggcgtacataaaagaagccgtaaagcaaagcctcaagcggctgcaaacagattatattgatttataccaattgcacggaggcacgatcaacgatcctattgatgagacgattgaggcttttgaagaattagtggaagaaggcgttattcgctattatggcatctcttctatccgtccgaacgtcattaaagaatacgccaaaaaatcgaacatcgtcagtgtaatgatgcaatatagtttactcgaccgccgtccagaggaatggttctctcttcttgaggaacaaggcattagtgtcgtggcaagaggacctttagcaaaagggcttttaaccgaaaaaccactttcacaagcaagtccatcaattcaaaaaaacggctatcttcaatattcatttgacgagctacagcaggttattccttctttaaagaaagtcgcttatgacctatcactcacagagctgtccattcaatatttgcttaagaattctgcggtcagttccgttgtatttggcgcaagctcggtggaacaattaaaagaaaatgcggcagcggccaatgcacgttctttaagtgaccaagaagtaaaagcattgacttactatacaaaaccatctgtgtacgaggcgcaccggttgaaatgagataaaagaagaggtcacctgatgtgatctattagaaaatgttgacaaaaggctaacataatcttttttagccctttgtcttcttttcagcgtatagactccgtttaccagcttttttgtttaataaggtaaagaagaaagacgaaatagtcacattagatgaatgagctcctaaaaatcatctgatgtgacatattgatcaagcgattgctaagaaattgaacccattgttgcttatcagaggcgttcgtcttcaaatataaaagaatcgctgaacaaaaggtgttttcaattggtatataaatagaaaacgaaaataagtatgaaaggagaatatcatgactgaactagaaaataacagtgttaacaaaacctgcgttccgactggtgttgaattaaaagacactggatttggatataccttgtccctaatagcaggtaaatataaaataattattatatattggctgtctgaaaataaagtgatgcgtcataatgagctaaagcgaagcataggttccatttcattcaaaacactaagcatcatgctaaaagagttggaggcagaagatcttattataaggacagaatttcctcaaatacctccaaaagttgaatattctttgtctgaacgtggtctttctcttgttccgttactaaatatgatgtgcgaatggggggaaaagaatcgttctcctgcttcataggacgtgctgagcagctagttcatttgattgaataaaaagaagtatccccctatatggagaaatacttctttttttagtttttataaatctaccaattacatgctttcaataaaattcaaataatcctgagtgcttttttccatttcgcttgtactaaaatcattttcttcttcttcatttcctcctggcgcattttctttaccataacacgcaaagtgcgaacgataatctgcactacaatacaggaatgttgttttaaatggaactaatatttgttcaagggtatatgtatatctcccgtttatagtataatcttcttttttgattcctgccgttacacctaaagcaattttacgattctttaatttatcccctccatttgagccataagcccatccataagttaatacatcgtcaagccatttttttagtagtggcggacaattaaaccaatgtataggaaattgaaaaataagttgaccgtgtgattcaaccattttttgttctttttccacgtcaatagctccattaggatagactttatacaattcatgaatagtatatttttccggatattttttaagctcttctaaccaccgtttattcataacggaagttgttatattcggatgtgcaataattacaagagttttcatcaatgtgtcctccttaaatcttatttatatcttaatagtaaattgaataaagaaaagatgtaagtatgcactttcagtacaggtacttacctaaaggttagtgttaaatcattttaaatcttgattatgatctatctcactaagctgatgacataaaaaaaagaagcatcagtgctcccttttttagcttttatattttctccagtccaaatgactttcatctagcagctcggagaagcttttgtttttttctttttctttctgctgccgaaggaggtcttgtcgtttttgttcttctcttttttctgtttcggcggccagattctgcttcatttgaaggagctgctgtttgagatcctcgtttatgccgtcctttaatttcgcttgatcattgttctttttcattgtgcctctctccttttgcctctaagtgtatcatccgttttatttcctgagcaagagtcacgccattctcccaacatgtggtatgatcgtcatagaaaaaacctcggaaaggaagaatcagctagatgaaaaaatggatcgctatacttgccttcatattatgtccgctcattgcaatcggcatttttttcaccaataaaatgatgtatattcgaaaactaacagatgaagagctcatcaaacgggaatcagatgaagggcattatcatcatgaagcgtttcaacagcttaacaaagagaaagtgtgtattccttcagcatttggttatgatcttcatggctattttgtgccgcactcacatccacatacaacacgcaccattgtactttgtcatggcgttacggttagtttaatcaattccgttaagtatatgaaattattccaaaaccttggatggaatgtgatgctttatgatcatagaagacatggaatgagcggcggaaaaaccacgagttatggatactacgaaaaagaagatttagcgaaggtcgtaaagtggctcagacaaagactcggagaaaatgccttgatcggcatacatggagaatcgatgggggcagtcacgactttgttatatgctgcaaagccggaagcaagcgccaatttttacatagctgactgtccttttgcttcttttgaggatcagcttctctatcgattaaaaacagattttcgtctttcagggcaatggattcttccactaagtgatcgagtgttaaaatggcgggatggatacagcattcggcaagtgtcaccgcttgatgtgatcgatcaggtgagagaacctgtgctttttatccatagtcttcatgatgactatattccatgcgagcagagtcagcagctatatgctcgaaaaaaaggtgataaacagctatttatagcgccgcacggggcgcatgcgatgtcttttagtgaaaataaagaagcttacgaacaagaagttcaagcattccttcaacaatttgcatcaaatgaagataaaagaggagattgaacagcggttcgtctcctctttttgagctaacttatgcgatagtcaccactgttgtatggtgtctgcccgccagttccatatgactctcttccgattgctgctgactcatgaccgataatcctgcagttgctgccaataaaagaactatcaaactcgttttcatataaatgacccccattttgaatttttgatatggcttgaatcttccgttcgtaaaaccgtgtcgatgcttcatacagtccaagctcattgtaataatgagccgcatcaagtgccaattcctcaatgtctgggtataagcgcttgtcctcaagcaggtctaatgtatcgtctatgatcgttatttctgcatcaacgtataatgcttttaagaactgaaatttgcagatgtaaatttcatcttctaattcacaggctttcataatacctttttgatagagggttaacgactcttctatttgtttttgtttaaacaggatttgggtgagcataaatagtgggtctagagagcgattaagatgggttaaattctccttttcaaacacttcaagagagtctttcagataacggcttgcttccgcaaggttgttcatttggtaataacagttacctaagttgaaaagggccgaacctatgactcgagggtttccaattgagcgtgctcgatttagagcatttttaaagtagggcaatgcatgttcatagcatttcaaatcatcatagtttgcaccgatgacaaattcacagtggatgattctcagcgtgtacgttctgtaggcagagtacgtatttaacgcttgcaaggcatagtgcatcgaaaagtgggtttgtttcatgtggtagtatatttcagctaatttaaagtaaaattctgctctttctatatcatctgatatgagattgagctttttttctgctgaacggtaataggcaatggcacttaaatagttttgctgttcaaactcaaacattcctgtgaaaaaatgaacatagtattcaagcatgtccgttaatttcgtttgtgaatgttcgatcgtttctagcaggtttttaatttcttcatcatttgaggctttctttgccggttcaaaatattcaagcatcaccttatggcgaaaatccatcagctggtaaaacagcaacaagttttgatcttgctccatctccagaatttcctgctcgatctcggccttcagcttctctgctttcatgacatgaaatccgcaaatctgcctataccattcgtttattttgattccaacctgaggcgatgacagcttgagcttcaattcactttagcacctcccttctcatatacgatacatgttgtattctatcacatttcctcgaatggaagaaatatgaaatgtcatttttcgcaaagttttcggtatcccgcaataaccgcttccattgcctatttttcggcatgtatattcacgattttttcatgtctatttttctcattttgtcgaattgcttgttataaaatgggggtttttcgtttcaaaagatcattttacagattagacattctcagctgcttggtgagatgatgaagacacgaaaaaagcccttttgtcaaaaagggcttttataatacatctgttacctgttccatattctctttgatccaattgacagctaattcgagtgttggaaactcttccgtttcaaatgtgacttcatcctgaagaagccaaacatcctttttcaccgaatccattccacctattgaccagtgcaaaagggtatagggatgattgttatttaaaaacgacacccatgttttattttgtgccgtgttttgtatcactctaagcttctgatccactacgtttccaccttactttacaagtatgcccattcttggactgagtatttgctgaggacttttcagcatcaatgtattggcttttttattaaaatcgatggtcatttcctcatcaaaaaataccttctgtgcaatgtgtatatatagttttaaatgttggctatttttaagttgttcccattcacctgttctttcacttgttaaccaaagcattggtacgccactcactgcacagccacaaccttctgaatcgtagcgaagcagtaattccttagtttcgttttctatttgctgtttttttatatatgttttagccagttctgtgatgtgaatatacatggagaacatccttttttaattgatgcttacattgtaacacataaaacaccataaaacatgacacacgactacacgactaaatccgaaaatcatattctttgaaatacacgctcttctcactaggattatatctatctattgactcttttcgcttcttgttttttagaattatactgatgacgctaccaatttcaaaagaataaacaggaggttttagatcgtgaaaaaaagattatctctctgcttcatcggggcactgatatttatgttgagtttcgctgtgccaaacatgaaagcgtcatctgtccttgatgaagtacgagaaagctatgcgacttatacgggatctggttactcagggggcgctgcattattagatcctattccatctgacatggaaattacggctttaaatcctcatgactataactataaaggggtaaatgcggcacttgcaggcgcttaccttgaagtaaagggtccaaaaggaaaaaccgttgtgtatgtaaccgataaatatccagaaggagcaaaaggagctcttgatctttctcctaatgcctttgccaaaatcggtaatatggcagatggtaaaatcccaattagttggaaaattgtaaaagcaccgattagcggaaatgtagcttacagaataaaagaaggcagcagtgagtggtgggctgcgattcaagtgcgcaatcataaatatccgattatgaaaatggaatattacaaagatggacaatgggtgaacatggaaaagacagactacaaccatttccttggatttaatatggggtctaaatctcttcctgttcgaatcacagatatccgcggggtcattgtaaaggataaattacccgctcttccatctactgctgcttcacaggcctatattgtaaaaggcaatgttcagcttcctaattaacgaggaaaagaggtagcttatttaaagagctccctctcttccttctctatcccagtgatatgcctcattttctatttcttttatgatttcattctttcctgccatatagctttgtatatcttccggatactgttttgctaattgttccttgacagacgcatacgctacagctcgttctggatgggcccttaagtaatctcgaaacaataaatgccttttcacatcagggtgatttctctcataaacatggacatgatgcgtacgattcaagccacccttttgaaaaaaacgtctcccttttatgccattttcacctagcgcttgatatccaagatgttcaaagctctctctttttctatcgatctcttttatatgacttacttctattaagatatcaataattggtttggcaacaagtccttcaactgacgtactaccaatatgatgtccttctatccagctcttttgaatgatttgcttgagttgctgcttttcttgatggaattcttcatgccactcttttttgaattcgacaacctcaacctttcgcctcggtgtccatgtcatttttgataaggtgagctcttttacaacatgaatcacacctgtttcaagaaatcctaacttttcatatagcctttttgcaggggtgtttttttgccctgtggtcagttctatagggacatttttctccataattgtggacataagtcttgttccaataccctgctttagcgcttttggatgtacagccaatcgactaatgatcaaataatctttctgctcttcataagaggcaacacctagtaagattcccttttgctcaaaaccaataaattgctcttttgctttcattacatcttgaatggtctcttttaatggtgggagatcggcatagccaatttgctcagcttcttgttggtatgcagctagttgaatatgtaagatctgctttgctacatcacttattgtttgatctaaattgacaatcattgcattgcctctaattttttcacaaataaaacacgatcttcatttattccatcatagtctgaaaacacggagattccttctacagtagttttgtcccctttttcaatttgaaagcccaattttgcatgataggcaatcgatactttatttacaggagctgttaccgctttaatagttgttcttccttcctgttttgccacatcataaaaggcttgatataggatttttcctatctttaatttccgatgatctggatgtaccccaacaaagtgaatatacgcttcatctgaatgagattgcgataaaaaaccgactaaaaagcctatcagttcacctttttcaacgacgacaaaacttgtttgctgaaaatgttcaaaaaatagcttcggcaattttgcgcgtaaatctctaccgccccaccagctttggatgacggatgtgacggcgtaaaaatctgacggcttcacttgacgtatcatgatgacctcgccccttttcatttttaacttaccgctctcttttttcacaaaaaactgttgtttcaatagtctacctgtccgatttattgtttgtaaagatcacgtgtcagcctttttcctttcagctttgttgattcttcgttctttcgcggtcatctccttttaaatcttcacacttatttcaaaaagttcactttttgtgcgaaagtttcattcttttggtatgttaagatggttcatataggaaatgtaacaaatgtttattggagatgatgatattggtttggattgttacttcacttgttgtgtttagtcttttaaagcttcttgtcacttcgctgccttctggtgttgtggaacgcctttttagccgttatgcagtgcatgcaaaagtaacaagtgatcaaacaacgatcatgtttgaagatcgtccgctcgatgatcagcaagcatctgaaattattcaacattttaatgatgcgatctttattgaacgctattatatttatcctggtgatgaagaacgctttctttgtccgcaggaagggcctgcgccgcttactatgcaaacaaagcttggcaagcatgatgtgaccctttatctgtatcattacgatgaccacgtggatgtggtgcggcaatttactcataagcctaagaaaaaactgacggcctatcgtttgcgttctgagccgctccaaacatcttacaatttagcacatgcttaaaaatatgtttgatcaaatgagacgaagtggaagacacttcgtcttttttatatggttttacactcttttctttgaatgatttaccagtatcaatttcgcctcttgacggttacaataaatatagaacatacgttctaagaggtgaaaataatgaatgaacgagccattctgcttgtggatatgcaatcgttttatgcgtcagtcgaaaaagtggaggctccccacttgaaggatgtaccgctcatcgtttctggagatcctgagcggcggagcggggtcgtacttgctgcctgcccgcttgctaaaaaacggggcgtacaaaatgcatcaagattatgggaagcacaggagaaatgccccgaagctgtcgtcgtacgcccccgtatgcagcgttatcttgatatctctgtcatgatcacagagctgcttgaacaatacacagatcttgtcgaaccgtattcaattgatgaacaatttctcgatattacaggtagtctgacactactcggttctccccgtgagatcgctcaaaatatacaaacaaccattatgaaccagacgggtatttacgcacgtgttggcatcggtcctaataaagtgctcgccaaaatggcctgtgaccattttgctaaaaaaaacacatctggcatttatgaacttcgcgcagacagtgttgcggctgatttatggccgcttccgattggaaaattatttggcgttggtaaacgaatggagcaccatttaaaacgaatgggcatcagtaccattgggacgcttgctgcttatccgttagaccggcttaaaaaacgctggggaatcaacggagagcttttgcagcgaacagcattagggcatgatccctctccggttaccattcacacacataatgaacaaaaagcggtgggacatcatatgactctcccccatgattatgcgtcttttgaggatatcaaagtctctcttcttgaattgagcgaagaagtggcaagacgtgcacgctttaagcattatcttggtcaaacagtgtctgttggcgtgagaggcgctgatttttctcacccgaccggatttcatagacaaactaagcttcattcgcctacacagtacgggagagatattgcagacgcagccattcagttatgccagcagcactgggatggtcagcccattcgaagtgtcggtattactctctcacagctgcagtctgacagtcagtatcagctaaatttatttgatcatcatgttcaaaaagacaaactcagcaaagtatttgatgcgatccacataaagtatgggcctgctgccttgctgcacgcttcgtcactgacaagcgcagggcaggcgtatcaccgcgccgaaaaaattggcggacattacaaataacggaggcgaacagccatgaatcccaataaattaacacctggatacaacctcatgtgggaatcaagccgaatgatgcttccagagcaccgggagcagctgcttgctcaaaaacggaagaaaaaagaatacatccctctcccgctgagcaccgatcaactggaggaaatgaattttttgatcacacagtcgattaccgaggatcaagcgatttgcgtgacatatgccgtagaaggtaggaaagagcagttttggggctgggtaaaagccattcattatgaaacgcagcgcataaaaatcatcaatgatgaagatgttctcaacctgtccttgcagcaaatcgtcgcgatcgaccttgattaaatggggtcaaatgaccgcacgaatcagtgtcataaaagcaccggaataaaaaagcacgcgtcttcaaatacgagctaatcaagcttctctgccatatggcggatgtcccctccatcaaattgtgtatttaatttgcacaatttttcatgtatgattggaacatcttacaaactcaggggagaaacagcatgaaaaataacttacgtacactacatccgcttagttggacgatcatcatcggcaccatatttggccgaatggcgacgtccatgagcattccttttttggccgtttatttaacacaagtcaaaggcgcctcagcttcttctgctggattaatcattgccgttagctctctgattgggatcgttgcgagtttttacggtggatatatttctgatcgtatcggaagaaaaaaggtcatgcttctatcaatcttcggttggacacttgtctttgttggctttgcatttgcagatgccatttgggtcttctttatcatgaacgctttaaacggactgtgccgggcactgtttgaaccaacatctaaggcgctcttatctgatgtcaccccatcaagtattcggttgtttgtgtttaatttacggtatacagccattaacattggtgtcattttcggcccgctgcttggcttatatcttgggtcatcaaaaacgacttttccatttctcgtcgctgccctcatttacttgttatacggattaacgctggcatggcaatttcaaaagcatccagtggctgctccagaaagcaccaaacaaatcggtgtcaaaaaagctctttccattattcagaaagatacggtctttagcatcatcctcattggcgttactttatgttcgtttggctattcgcatctaagttcaacactgcctcaatatttatcagcatcgcctatgattgaggatggccctaagctatttggttatcttttatccttaaacgctgttgttgtcattgtcattcagtacccgctgattatgatcgccaagcgctattcaacgattttgtcgttaacgactgggaacttgcttctagcaggcagtttgtttgccattgctttttcacaaagtctcggtgcgcttgcttttatcattgtcgtgtttacgattggtgaagtactgctctttgcaatgatggatctgtttgtggacaatattgcaaaacctgaaatgaaaggatcatacttcggcgcaatggggttttctcagctaggcagcgtcgtcggaccgtttgtcggaggattgtgtattgatttatttggtgcatcccatcccctttccattttttcagtcttggcgattgtcactgctgcaggcgttccgttcttactcatcggatactaccgcctaaaaaaacgaacggcggctgccgtcgctgtaaaagtaagtggaggtcactaaaaaaaaccgctctcgtttgagcggtttttctttatactcggcggatggcgatctcttccaccttatgctgatcgcctttttttaaaatgagatcagctcgatattttgtcggtaaaatattttgatataaattagggcgattgacagtattccaaattgtgcttgccatgtgatctgcctcttcatccgtcaaatctttgtattgatgaaagaaggattcagggtcttggaaagctgtttccctcagcaaacggaaccgttctttataccatgattgaatttgcgcttcagcagcatctacataaatcgaaaaatcaaagaaatctgatacaaacacacgcggttcatccttcagatcatccagcgctggggattgcagcacattgattccttcaatgatgacaatatcggcatcttccaccgtttcatacacaccttcaaggcggtcataagtcagatgcgaatatacaggggcatgcacggtttgtttccctgattttaattcgtttaaaaaagacaacaaggctttgacatcatagctttccgggaagcctttcttttccatgagtcctcgatcctttaattctttttgaggatacaaaaagccatctgttgtcacaagactcactttcagtccatctccaagcctcgataaaagtgtttcgatgatacgggccgttgtgcttttcccgacagccacacttccagcaatcccaattagaaaaggaattttcgcatgatgcgggtagtttaaaaaggcattcacatgctgatttttttgtttttctgcaaagacatgcaatgtcaaaaaacgaataagtggtatgtaaatatcttgaacttcttcaagcgataaatagtcatttaatccttgaagtgctcttgcttcctcttctgaaacagataccggcatatattctccaagagcagaccaagcctctcttgtatgacgtgtatataaagtattaaaatctagtcgtgtgtcactcaaagtctttcccaccaatcttcactaaactcgtaaccaaaaagacgataatccgattgtagcttaaaatgaaggcgctgtctttatttttccactaaagtttgcttcttttgcgaaaaaaaagcattaaaaaaaggaaaatgagggtaaataagagtattcagttcgatagatagaagggagcacaccaaatgaaatatgtgatcattggcggagatgcagcaggaatgagctgtgctatgcaaatatatcgagaggacccggatgcacatattgtcgcttttgaaaaaggagagattttctcatatggacagtgcggcctcccctacttgatcggcggtctcattgatcaccacagcaagctgattgcacgcagtgctgaaacatttcgcgacaaatacggaattgatgctagatgcttacacgaagtgacctccattgacccaaagcaaaaaatggtgtcaggggctcatacgaaaacaaaagaatcctttaccgaaagctatgaccgcctcttaattgcgacaggagcaagccccgtcacactgaatttaaataatcagccgctagaaggcgtacacgtattaaaaaccattccgcatgcgctgtccattttagaccacttaaaacaaaatatcacacatgtcaccattatcggcggtggatatatcggcttagagctggctgaaaatttaaaagcactgggaaaaaatgtacatatcattcagcggggttcaacacttggtccgggctttgaccccgatatggcaaagcacctgaaagaagaggcggatgcccaaggcattcacgtgactctcggggaaaccgtgcagacattagagggcgagtcacgtgtcacagctgttcaaacagacaaacaaaccataagaacagatatggtcatcatggccatcggcgtcaccccgcaaacctcttttttagacaaaacaggaatcaaacgactttcaaatggtgccattgttgtaaacgaattcatgcaaaccaatgtaaaagacatctatgctgccggggattgcgcagccacttatcaccgcatcaaacaatcactcgattatattccgctcggcacaacggcgaataaacaaggaagaatcgctggttttcatatgacgggaacaaaccgggcgtttcaaggcgtgactggaactgccgtcatgaaatttatgagcatgacagcaggacgaacgggtttatctgaaaaggaagcacaagcagctgatattcctttttccaccatcaccattgacagtacagatcacgctggatattatccagatgcgcaaaaaatgaaaatcaaactgctttacagaagtgatgactacaccttgctcggtgcccaaatcatcggaagaaacggtgtagataaacggatcgatgtgatggcaactgctctttaccaacagctaaccataacagatcttgaagatttagatattagctatgcaccgccttttaacagtgtgtgggacccgcttcagcaagcagcaaggcggagataaaaagacggtcacaatggcgggcttacttcaaaaaaaagaaaccagttcacgaccggtttcttttttgttattttttcatcatcgctttgcgtgctgctttttcaaataaaaatgggaataattgatacaatttactgccagtgttcatccatccaggcagattaatctctctttttttcgtcatcatagcggatacgaccttccccgccaccttgtccgcactaagcatcatgaattcaacattcttcacatattcaccgctgcgatcggcgatggtaaagaagtcagtggcaatcgggcctggattcactgtagtgacgtgaatgccgatgtctgacagctccattctgaggctgtttgaaaagccaaggacggcatgcttggatgcagaataaatggctgatttcggggtggcaatctttcctgcctgagaggcaatattgataatatgtccgtgtcctctttgtttcatctctggaatgacctttttcgtgcaggcgattaaaccaaacacgtttacttcaaacatcgacaccatttcctcaatggacgcatcttcaacgagatcaaacgcaccaaaaccggcattgttcaccaaaatatcaacagcccccacttctttatatgcgcgatcaatgtcctcaagatgactgacatctagctccacgatgtgacacaccccgccagcactcataatcttttcttttacacccgccagcttttcaattcgtcttgctgaaataatgatctctgcgccttctgctgctgccaagtacgccattttttcaccaatgccgccagatgcgcctgtaatccatattctctttcctgttaatcgccccatgcgtttcactccttagtttgccctgtaatagagaattccatctttttgcacttcttcaatttgtccagcttctaagaggacatccagttgcccgactgtctctgacatcgttaaaaacaaggcctcttcatacagcactggaaatagcttgcggcaaagatgaaaggcagtcatttcttttcgtttaagcagctgatacatcgtatttgcccgtttttcttgtttcttaaatctttcttcgatcaattcatgatgagacgtgatgagctgcccgtgtcctggataaatcgtcttgatcggcagatgaagtaatcgattgagtgatgctttatattgaagcagcgatttttggcgttcctccccttcatacggcgcttccattaacgggtttgaggaaatagtcgtcaaaagaaggtctccaccaatgaagtggcccgttgtttcatctagaaaggaaagatgagattgtgcatgtcccggtgtttccatgacgaaaaaatgttcatgccctttcaaccgatcgccttctttgatgacgtcatctacatgtgcagtacaggaatatgtataagattgcttcacgattctatcacactcatcagggcgaagcggcacacctaactgctgaaaaaagtgtttcgtaaaagcaatttgatgctctttaaacacagggtcctggctaatatacggctcatttacctcatgtccgatcacacgaacatgaggtttcatcagatttaaaagaccgacatgatctgcatgatgatgggtcaacaccacttgatcaatatcgtcaattgataaacgatgctcatgtaattgcgtgacaaaggcgtgctccgcctcttctgtcatcggcccgcagtccactaaagtcacagcttctccttttaaaatatatgcatgtacatccccaacagcaaaaggggtcgggatagataattgaatgatgtcttctttcacttttttatgtcatctcctgctttttgactcatgattcattgtcacttcgtcttctttattcattgtatcctgcaaagggcagactgtcatgcggtttaggcgatcaatttttttatctgtccctattgacacaaacttgtccatcgttgcataatgaacaacaaatataaaatgcgtgatgacaaggattagtaagcaaaataatgatgcaagagagtgaggtccgccggctgtaagacctcaccatcctcttatttgctgaacctgccctttgagctgttaggcaaacctaaacgtttcccgcgttaagggactagagctgagtatgcatatttgcatgctaattgagggtggtaccgcgaaaaacctttcgtccttttcaggcgagaggtttttttattttctacaaggaggagcggcttatgagtaaaattggatttattggtgcaggctcaatggcagagtcgatgatgaaaggtttattaaaaagcggcatcatgtcaaacgaagatattattgtcacaaacaaaacgaatgaaaaacgtctagaagaattaaaggtgcgttatggggtcaaaacggatttctctcgttcttttatttatgaagaagcggatattctcgtatttgctttaaaaccgaaagatgctgaaagcgggatatctgaagttcggcctcatttacaagggcagctgatcatttcgattttagcaggcatctcaattgaaacgatccaacactatgctggcgagaagactgcggtggttcgcgcgatgccaaatacatcagccgccattcagcaatcagcaacaggcatttctgtcagtcaagaagtgacagaggatcaaaagaataaagcaatcgagctgtttgaaacgatcggtcatgtgacggtattagatgaatcacagcttaatgctgttacagctattgcaggaagcggtcctgccttcatttatcatttgattgaaggaatggagcgaggcgcttcggaacttgggatggaccaagcaacagcgaagctgctcatctgccaaatgattgcgggtgccgccaacatgcttcaaagcagcggtaaagaacctgctgaactgcgcaaagagatcacaagtgaaggcggaacgacagaagccggcctgaacacacttgctgcctatcaatttgaagaagccgttgtcgattgtgtcaaaaccgcaacaaaacgagcagcagaattaaacgaaatgttttcagcaagcacgtataaatgatagagaaaagcacctgtgttgatgacaggtgctttttgacatacgcatctattttttctcactagcaacttgatgcaaactgcctgtttcacacttcggtgcttttttagaaatggcttgttctaataaagaattacgtgcctgataaaaattcatatcgattaaccattcttgatgcttcactaattagcacctcctcatgcagatgattcactcattgacatgatggctttgatttgatcgagatgatgtagttcatgtaaggcgatcgtttcagctaatatttgcactgtcatcaccccttcttcaggatgcagacctgattgctcccatgtatcgttttctaatagatgaagtgtcttgcttcttctctctttcagtcttttaatcaatgctttgatttcctgtacgttaaatctttcgtaagctctttccttcacatacatttcaggatcatacgattgaaaaggcgtatggtcatttgatattgcttgctttattcgctctgaccagacttcttctgtatcatacaaatgccctgcaatttgcttgatcgaccacttgccctctcccaaagattgatctagtgtgtgctcatcacatgtccccactagctgttctagttcacggatactttcctgaagcgatgtagtaatttctgtttttgttaattttccagtttccatttcattctcaccatccccttcaaataaatgtaagtcatattctttatcatactctatttatctaagtcgtcggatcgtttatttaaaaataaaaagccctatcatcacgataggactcttcatcatatacttactttttctctaacaaagcatgaatcgctgagtctaataattctggcaaaatgccaaatgagaacgggatgtgcaggcgctctgtccatttgtgcgggtcctttcctaatggacccacgttgatgactggaacgtaaagtgctcccttttctccttctggtaaagaatagcctttctggtaaagcggcatattggtcgtgtaatgccctacgtcctgtttttcaagctgtaagtaacttaaatcagacaatcccggaaaatatttcacttcttctatttcaagaccataactcttcttcgcctcaatttgaatcctctttaaggttgcttggatatgcggatcttccgttgaggaaaccgctggataaaatggcggactataaaatagaacaatgagcggcccatcttccttacaaagcgtcgtcagctcagagacgattttggttgaaaaatcacgatctccaagctcacctcgattggcaaacgcatagtttacaatgcgttcaacctcctgtttacctgagcgttcagcagctttttgatacagctcatgatacgtgagaacggtgattctcgtatcaatcggtgtaaatggtttaaagcgctgaaaatctgctgttttttgtttgagatcagcttcgatttggtctgctgcttgtttcgccgtgtcataaagaagcccatgcagttcttcacttgaacgattcatcatcagcacattaaataaagaaacagctgtgtgaggtgtttgaacggaataggcttcttttaaatccttttgcattaagttagttgggggcggcgtgacttccccatctacttcctcacaataatcactattcagctctaacagccgatttaatgcagataccataaaattcgcatttaagcctgagaacggctctcctacatgtgtttcaattcctttgcagaaaaatccggccagcaccttccctatactgcctgtatacatataataatgttcatcacctggatacttttcaaacataggctcactgtttaagcacgcggtatagtcaaggtcatgcttttccttaagctcctttagttttggaacagcttcaagcattccttgagaattcacctcttcatccgggactgtgacgagtaggacatttccatcaaatgtctctgccatcgctctttccagcatagacagctgtacagtaagacctgccttcatatccatggcacctcttccaaacaaccagtcacctgaagctagatcttctcttgctctttttgggagaagcgcacttttttgagaaaatgaggccattaactcctctggcttgcatgccatgttttgaaattcaccgtaatcttctgtatcgacaacatcgaaatgactaagcagcaaaacggtacgagaaagagaacggcgctttacaagcgccgttaaataataccggccatctttcatcggatgcaaagccaaatgatcaggattctgcttgtaataaggccgctccctcagtaaataatataaatattcagctaacgcaacttctccagttgtacccgatatgctttcatactgcataagagctgtgagcagttcctttcgttcactctctgtttgccatttcattcgttctccccctttgctttctctatttctccattatacaaaaacgagtataaaagctatattctttgagcaccttttatgacgaaagtttgattggctgttataatcggctatacaattctatgaggaggcgaaggtatttggaaacaaaactcttttcaccttggacattaaaaggtgttacgctcaaaaaccgcatcgtaatgtccccgatgtgtatgtattcatcctatgatcgggatgggaaattacagcctttccactttacacattatatttcccgtgcccaaggtcaagctggcctgatcatggtggaggcaagtgccgtttcccccgagggaagaattagtgatcaagacctcgggatttggagtgatgagcacattgaaggcttcgcttcattaaacgaacagatcaaagcctacggaaccaagacagccatccagctggctcatgcaggacgtaaagctgaactagatggtgacatcctggcaccatctagcattccatttgatgaacagtctaaaacccctgtccagatgtccgtcgatcaaatcaaagatactgttcaggcgtttcaggatgcagcagtccgggcaaaaaaggccggctttgacatcattgaaattcatggggcgcatggctatttgattaatgaattcctttcaccgctggcaaatcatcgaacagatgattatggcggttcaccagagaaccgttatcgtttcttaagagaagtcgtcgatgcagtcaatgaagtatgggacggcccattatttgtccgtgtgtcggcttctgattacacgacaaaaggacttgatattgctgattacattggcattgctacatggctgaaggaacaaggtgtcgacttaatcgatgtcagctcaggcgctgtcgtacaggcgaaaatcagcacattccctggctaccaagtgaccttcgcagaaaaaatcaaagcaggtgccggtattcaaacaggtgctgtcggtctgatcacatctggtgtacaggcagaggagattttacgaaatcagcgtgcagacttaatttttataggcagagaatttttacgggatccatacttcccaaaaacagctgctgaagagcttcgtacatccatcgaaagcccgcgtcaatatgaccgcgcttggtaaaaatgcataggaaaaaggtgtctattttttgaaataggcatcttttttgtttttaagagaaacatatctgccttttgtgccgtcttttagctaaagaaccacttagaggagatggaagaatgaactcggcaatgattgaaagaatgtatcatatagatggacatcatttttatacaaaacatcgtcagggcaaaaggcaagccaccattatctttgaagcaggctacggcatttcgggtgatacgtggtcgaatatggcccgcgatattgatcctgagcttggggttttcttatatgatcgattaggaaatggaaaaagcagtgagagcagtgaaggaagaacattgcatgatcttgcagatgatttagatgcgctgctaaaagaagccaatatccagccgccttttctcattgtggctcactcatttggctctcttgtcagccggttatgggcaagccgcagaggggatgacgtcattggcatggtgctgttagacccagcaagtgaggagcaagagcaggtgatcctgccgcttttatcaaaggaagaacgcacctcatatatggcgcagtttacagcagaatgtacgcatgaggattttcagcaaatgctcagcacaatgaaagaggagcaaacccattatgggatgatgcccctccttgtcatttcatcaggtaagagccgattgtttcatccagcacacgaggcatggctcagacttcataaacggatgctgtctttgtcatcccaaagtggatggattcaagcgcagaacagctcgcactatattcatcatgatgaaccgcatattgtgcagcttgcgatctatgatgtatggtgcgcagccaaacaacctgtttcctattatcaaacagccaattaaaaacaaaaactccttgactagttttgcgtcaaggagtttttttctttatgccgttggagctgactgactttttttagacagcagcttttcaatgctgacaagctgaacacataatgtaaagatgtcaatcgcttgctctagttcttcaagtgatgggaacgttggcgcaatgcgaatgttacgatcaagcgggtcttttccataaggataagtcgcgcctgcacctgtcatggttacaccagcttcttttgccttttgcacaacagcttttgcacaatgatcaagtgtatttaaactaataaaatatccgccatttggcttgtgccattctgcaatgtccttcccgccaagtgtttcatcaagaatggaaagaacgaggtcaaactttggcttaatgatcgctgcatgttttctcatatgttccttcaagccttctggattcttgaagaaacgaaggtgtcttaattgattgattttgtctggtccgatcgtttgaatcgatagttgtttttgagtgaagctcacattatccgggctagatgccatgagtgcaatacctgagcctgggaatgtaattttagaagtagatgcaaacataaatacacgattagggtgccctgcttcctctactgcttgaaaaatatcttttaacgtatcaggcgtatccgttaggtgatggactgcgtatgcatcatcccaaaaaatgcggaagtcgtctgcttttgttttcatcgaagcaaggcggtcaaccacctcatctgaatacgtaatgccatctgggttgctatattttggtacacaccaaatgcctttaatcgcttcatcctctgcgaccaatttttcgacctgatccatatcaggtccatcagctttcatatctaccgtgatcatctctatgttaaatagctcacaaatggaaaagtgacgatcatatcctggacttggtgcaaggaattttacttttggcagctttccccaaggtgttttgctgtcatatacgccgtgggtcatggcacgggcaatggtatcgtgcatcatattcaggctggaattaccgccgatgatgatttgttctggcttcagattgagcacatctgcaaaaaatgtcttcgtttcaggaagccctgtcaaaccgccatagttacgcacatctgtgccatcttcagccgtcatcgcatcctttgatgtcacaacatcgagcatacccatagacaaatcgagctgttttggtgaaggttttcctctagacatgtctaagtgtaagtttttacttttatacgtttcgtactcattttgtagtgctgcatataggtcatttaattctgcttcacttaacgctgtaaaaccgctcatctttgattgtgcctcccgtattcttcatagtttcattcgtcatttgttttttcttcaccattttaccactacctgaaaaagagagtcattataaatatcaaaaaaatcacacaactttttttgacgattcatccaatttttacagggtgcggtcaatggaaaaagaagagaaatcctgtgcagcttctgtcagcgggaatatatcgcgtgcctctttcaatagttgttttagtgcctcttctccttggtaacgtgcactaatatgggtcaaaattaatctttttgcgcctgcttcctgcgctgttttcgctgcttgttctgtcgtgctgtgataataattgtgggctagctcagcatcttctttaccgaatgttgcttcatggactaacacatccgcatccttggcaagccttgttatattctcgcataaacgggtatctcctgaaaatgcaacgattctcccttttttagggggttccaaataatcggttccatcaatgattcttccatcttcgagtgttacggtttccccattttttaacttctgatacaaaggtccaggttttacaccgatttcttttagatcttcggcttttaatgcacctggtacatctttttctactacccgatagccgtaagctggaatcccgtgagatactcttcttgcttctacttgaaaggtatcatcttcaaatacgatcccttcatctatctctatgatatgcagcggatatgtcaaatgcgtttgtgtagctgaaagtgctgcgttcacaaacgctttgatgcccttaggtccatagatcgttagttcatcttctccgccttggaaggatctgctcccaagcagtcctgggagaccgtatacatgatcaccatgcatatgagtgataaatattttctcaatctttctcggtttaatcgttgtatgtaatatttgatgctgcgtcgcttctccgcaatcaaaaagccacactgcttttctttcttctaaaagctttagtgcagtgcaagtgacgtttctagttttcgcaggaatgcctgcacccgttcctaaaaagagcagttccattacttttcctcctaaagccggtatacaatatctttattcatatagaatacatgaagacaaggtaaatgtgaattcagcggaattttcgaaaaaagtcaaacgagagcagaaaaagtcgaatcaaatgtttgctttacgaacaatgaacctttaaaataaagaaaatgtacatacattctcggtttttacaacaatgctacgaataaagtgaggtacttttcgtgaatacagaaactaacaatccaaaagcagtcattgtcatttttggcgcaacaggagatcttgccaaacgcaagctctacccttctatacatagactttatcatagcggaaaacttggcgatcaattcgccgtagtcggtgttggacgccgtccgtggtctcatgaggatctaagagctgtggtaaaagaatctgtttcttctgatgatgcagaagcgaaaatagaggaattcagttcacatttttattatcacgactttgacgtatcaagccctgcttcctatcaatcgcttaacacacttctaacaggccttgaagatacgtacagtatcccaaacaaccggatgttctatttagcgatggcaccggaattcttcggaacgattgcaaagttcctaaaaagtgaaggtgtatcaaaaacaactggctggtcaagacttgtcatcgaaaaaccatttggccatgacttgccaagtgcgaaaaagttaaatgaagaaattcgagatgcattctctgaagatcagatttatcgtattgaccactatctcggtaaacaaatggttcaaaacattgaggtcatccgttttgcaaatgccatctttgaaccactttggacaaaccgatatatctcaaacattcaaattacatctagtgagtcattaggggttgaagaccgggcccgctattacgaaagttcaggtgctctaagagatatggtccaaaaccatatgcttcaaatggttgcacttttagcaatggagccgccaattaagctgaataccgaggaaatccgcagcgaaaaacggaaagcattacgcgctcttcgtcctttctctaaagatgaggtcgatcaattctttgtccgcggacagtatgatgctggtacggttgatggcggcatggttccttcatatcttgaagagcaaaatgttgacccgaactcaaacacggaaacattcgttgcagggaagctgctcatcgataactttagatgggccggcgtgccattttacattcgtactggaaaacgtttagaaaagaaatctactcaaatcgttgttcaatttaaagacattccaatgaacctgtactatggtaacggaaattccatgcatccgaacttactcgtcattcatattcagccagatgaaggcattacccttcacctgaacgctcgcaagcttgatggcggtacatttgcaaagccgattaagctcgactaccaaacaaaccataatgacatcatgaatacaccagaagcatatgaaaagctgattcatgactgcttgctgggtgatgctacgaactttgctcactgggatgaagtggcgctttcttggaactttgttgatccgatttctgaaaaatgggcagaaaacaaaacattaaaaccaaattatcctgctggttctatgggaccgaaagaagccgatcagcttctagaaaaagatgggtatcattggtggaatatataaaatgatataaaaaagagcagtctccctcgggggttctgctctttttttaacgtcctgttttcgtaatttcaaccgttgaaaagtcgaacttatcatatcgatgatgactaaaggagtactcaaacggctggcctgtgtttaaataagcaacctgttcgacctctagcacaggatccgttgggtcacagcctaaatattgctggtctagctcgtctgatttagccgctctaattttcttatgcgcgcctgccacttttaaattcaaatcatttgatatgtagccatagatggatcccaataaaacctcttcatctattcccttaataagattgacgggcataaacgttttttctaatacgtatggctcctcgtccacaagacggagacggatgatgtcataaatgggtgtggtggagtctatggataggtgggctgccacctctttgcttggaaaatggacatcaaagtgaatgatttgagtcgtgacgtttttatccgccatgacttttgtgaaccctttattttcatgtcctgacacattgattgccccttgattgagcgctgccttcacaataaatgtaccgtgacctctttttctaaagaggagaccttctgctacgagaagatcgagcgcacgcttcatcgtcattcggctgcattgaaattcagcggcaagcgagttttcatctggaatgggttgatcttctggataatatgctgttcctattcgttttctgatttcttctgaaatgagttcgtactttttcatctcacaccaccaactgacttgttttttcatagcttcctctcattctacactaagcctagtgagcttaaaaggtaccagccatttttgtttcatccacttaccgtcacataagaaaaatacttgcccttttcaaggaaagagcaagtatcttgattaaaaaccgttattttctgataccgattgaaaccagtatccacttttcttaatcgtacgttttccgtcttcttgaagatcaactgagacaaatccatagcgattcttataggcattcgaccatgaccagttatccataaaggtccacagatgatagccttttacattacttccttcttgaatggcttgatgcacccatttcagatgctctgaaataaagtcaatgcggtaatcgtcatgaatcattccttcttcatccttaaaccgctcttctccttcaacacccattccattttcagaaataaaacattcaatattatcatagtctgtttggacttttttcaatatatcataaatgcctttttcatagatttcccagccacgatacacattcatttttcttcccggcatgtcaaatgcatcaaaataatgatttggcataaatggggcatttggatgcggcatatgctctttcgctttcactcttcttggctgataatagttgattccaaggaggtcgacggtattctctcgaatgagctcaagatctccttcttccatactcggcataaagccttctttctttaagacctctaccagtttctctgggaaatgtcccttcaccgcaggatctaggaaggaacggttaaagaaagcatccgccatctcagctgcttctacatcgcgcggattctggcttctcggataagatggggtaagattgaggatgatgccaatcttaccgccttgcttcagctttttataagccgcaatcgccttcgcatttgataaaagttcatgataaccgacctgtacagccttttggaaatcaacttcgtttggataatgaaagctatacatatatccgccctctacaggaacgatcggttcattatgggtaaaccattttttcacccggtcgccaaataattgaaagcacaattctgcatagttcacataatcatctactacctgtctgttgacccagccgcctttttcctgaagtgccattggcatatcgaaatggtacaggttcacaaacggctcaatatcatgtgcaatcaattcgttgatcacatcattgtaaaaagatactgcttcttcattgaccgcacctgtcccttcaggtaagagacgtgaccatgaaatggacaatctgaatgaattgtgcccaatttctttcatcagacgaatatcctctttatattttcggtaaaattgagatgtcacattcggtccaacgccatcaaaaaaacgagtcggctcttgctcaaaccaatgatcccaaatattcggtccttttccatcaccagggacgcttccttctgtttgcgtggcagaggcagaagatccccaccagaaaccttctggaaatgtatatatttgcttgttattttccatcgacatgtattgagtctccctcacctttgatgttagttgtttttgttttttccgttgtggttattttttcatttttcacattcatacggtcaataaacttcaggaacgggaaccaaatgacaaacacgatcatcaggttaaacagctgaagaagaccgcccgctagtgaattggttgccatgattccgcttataaagatcggcaccgtccagggaatattcacgccagtcggtggtggtacaatgcctgatgccatcgcaaaatacgaaatacatgtaataaccattggcgccaaaatccatggaataagaataagcgggttcatgacaatcggtaagccgaaaataatcggttcattgacgttaaataatcctggtcctaagcctagctttgctacctgttttaattgcttacttttcaggaaaattaaaatcgtaaacacgacagctagcgtcataccggttccgcccatgccaaccgtataaatttctataaactgcttgctgatgatatttggaacctcaccagtttttgtatagctctctaggttttgaatggacaacgtattccaaatggggtccatgacagagttgataataatttggccgtgaagcccaaagaaccaaagaatttgtataaagaaaacagcgatcaaggtaggaatgataccgcttccaagtccgacaagcggtgcctgaatcgcatgataaatcaagtcatgcatgtttgttttgaagccttgtgtaatgatgatattgatcagtaaaaaggttgtgagtgtcaaagtagccgggatcagtgcagcaaaagactttgaaacagctggcggaaccccttgcggcatattaatgacaaatttcttttggacaaaataacgataaatttcagcagacaaaaagcctgtgatcatcccaaggaacatcccctttgctcctaaacgatcgactgggatcacgcctgcaatagatgcaccgccttcttgttctagtaaaaatggcgttagaagtaggaaagaggctaaagcaatcacgccgccaaagacagcttccacatcatagcttttcgataaatagtagccaatcccgaatacaacaaacacactcataatgctgatggtcgcacttggcgcgatattcagtgcagactggacaccttccagtgcggtttgactcatgattttatctaaaaatggcaaattcattagcacaaccattatggaaccaaaaatagtaagcgggaacgcaagcataaaggcatcccgtaatacacctaaatagcggttattgttcagtctcccagcaatcggaaccaaaatggcacttattttatcaaacattggtttccccccttgtttacaccctttattgtttaagcgattggaaaatcggcaggagctctcccacaagctccttcatcgtaatagtcgacattaagtggtcttctgcgtgcatgagcaataaggagaaaggcgttttctccccgcctgcctcttgctgtacgagttgaaaatggatgccatgtgcatgacgtaaatcttcttcggcttctttcatgagaccaaatgcctcatcttcttgaccttctcgaaattgtttcagagattgaagcaatttgctgcgtgcattaccgctgtgtaagatcaattgaaaactgacttgttcctccgtaagcccttcgagtgttttcttttccattctttacgcttcctccatcaatgaaacggcttgttcatacgctttttgtccatcggcaagcccatacgcctgcatatcgatgacctctactgcaatcccgtattttgttgcttctttttgaagatccccttttaaaaagctcatttgcggtccaattaacacaacatccgcattcgccatttctttcctcgcttgatcttgtccaactgcccaaatttctgcctcgtcccctattgagtcggcatgagccttcatctttgtaactagtaaactcgtagacattcctgaactgcatgctaataaaatacgtttcatttctctcaccccattgttgtaataaaagcgcttccagttaatattatatatttttatttctaaatgtctagacatttagaatcatttgtctgtattttatataaaaaagagcgtatgtgtgtgtacgctctttttgtttcttcttatccttttcctgcttggaagccaggatactttgtcatgccgccgtccacatagagcgtcaaccctgtcacatagctcgcctcttttgacgccagccagacagcacatgctgctacttcttccggttttccaatataaccaattgggatcagttctatcacgccttttttcaatgctggatcatcaaatttttcggcattgatcggggtatcaattgcgcctggtgcaatgctgtttacgcggatttttttaggggcatattctagtgccagcgtttctgttaaaagcttagcgcctcctttacttgctgcataatggacgaaatgcggccatggaatttgttgatggaccgatgacatattaatgatcgatccttcaattccatgttctgtcatatacttcaatgcatcacgacagcctaaaaacatacctgttaaattggtggacatcactttgttccaattatctagcgtcatctccgttgaagggacttcattttcaattcctgcattattaatcatgacatcaagactgccatatgtatcgacagcttgatcaatcattgccttcatatcctcttcctttgatacatctcctttaattttgacagcctgtccgccacttttctgaatctcagcaatcgtgtcgtctgggttttctttgtcggagaaataattaattaccacattggctttttcttgtccaaaccggcgcgccatcgcttgacctattcctgtaccagctcctgtaatcacgactgtttttccttctaaatctggatacattcgtttaccctcctattttgtaaatcctaatagcacgccgcctgcaatgatcatcaagcagcctgcaatgacaaaacttgttctggatgctttctcttttaataagtaaatgccgcctaatgtcgagataacgatccctgtctgtgacatcgaaaaacttacggcgacaccaatgagcggaatggccaaaagaagtccgagatttcctgtcgaccaaacaagcccggcaatgatatttttgaacgtatatttactaaacgggttctgcttaagactaatcgccaaggatgaaagcagcatgccgaccgattgcggaacgagggcagaccagccatcaatatgaaaccatcgcaaaataacaacatatccgacataaccaaccgttgagataagcagaatcatgatcccttttttgaaattgcctccaccgttcccaccgccattctttttttgaccgagcgatgtcagcacaacacctgcaataatcagtaaaatggcacaagaaccaatgagtatgaccgtcatcgtttgccattctttgaagaccatgacgccaaataacgtagtgctcacaagctgcatgccggttgacaaaggaaccgccttcgagactccgagaaacgcaacacttgaaagctgattcatttgcccaatgctccaaaagatgcctgaaatgacagaaaccgcaaaaataaacggtgtcagctctggcattttgatgaagaaggctgcaattgaaaatataaatgcgccaagcgtaataccgagggtttgctggtaagcattcccgccaagtttgacactgatgagaacaatacttccccaaaatatcgctgggagaagtgcatataagatgcccacttcgatccctactttcttttcttttttacatagcatccctctttttcgcatttttagccgaaaagatgcaaacacaaaaaaaccttaccaaagggtaaggtttttcagtcattctatgtttatttcatccattctgtatggaagatgccttctttatctgtgcgctcatacgtatgtgcaccgaaatagtcacgctgcgcttgaattaagttcgctggcaggacagctgtgcgatagctatcaaagtaagcaagtgcacttgagaatgaaggaacaggaactccttgctccactgcaagtgaaatgactttacgaagagatgattgatagctttgagcaatatccttaaagtaaggatcaagcaataggtttttcagttctggattacggtcatatgcttctttaatttgttgtaagaaggctgcacgaatgatacagccaccacggaagatcattgcaatttcaccgtatttcaaatcccagttatactcatcagatgctgctttcatttgcgcaaaaccttgtgcatatgagcagattttactcatgaataaggcttttctaaccgcttcgatcagctcttgtttattctctgctgattgtgctggcttaggaccttcgattaattgacttgcttcaacacgctcatctttcatcgctgaaatgtagcgcgcgaaaacagactcagtaatgattggaagcggaacacctagatcaagagaactttggctcgtccattttccagttcctttttgtccagctttatctaagatcacatccacaagcggctggtttgtttcttcatccacttttgtgaaaatatcagctgtaatttcgattaaatagctgtcaagctcacctttattccattctgagaatacttcatgaagctcctctgctgacaatccagccacatgcttcaagataaagtatgattcagaaatcaattgcatgtctccgtactcgatgccgttatggaccattttgacataatgtcctgcaccatctgggccgatatatgttgtacatggctcgccatctactttcgcagagatcgcttctaaaattggtttcactagctcatgcgcttctttttgaccgccaggcatgatcgatggaccttttagtgccccttcttcaccgccagaaacacctgtaccaatgaagtggataccactttccgcaagctcttgattacgtctttgcgtatccttgtaatatgtatttccaccatcaattaagatgtcacctttctctaggtgaggaagtaatgattgaatggttgcatccgttgccgcaccagcttttaccattaaaagaattttacgcggtgtttcaagcgactgaacaaattcttcgatgctgtatgtgcctacaacgtttttcccttttgattcttgaagaaattcttccgttttgctgctagatctgttataaacggacacggagaacccgcggctttcaatattaagggcaaggtttttccccataacggctagtccaaccacaccgatttgttgttttgacataattctgacgtcccttctaacacactatattgattactgctgaaatgatgtaccctttgaaattaccacaacaccacctcttttatcaagttttcaggctagtcatttcctcttttgtcctgaaaaaagtctttattaaaacttgttccacttgttttgctctctttttccttgatagttatccctctttgaacgagtgattttccatacttttctttcagtccttctaaaatggtttgaagaggctcttcttttgcatcttctgtataggaaaataaatcaagctgtttaacggctgcttttcgttctacaagatctgtccccgtcacacctaagagtctcacaggctggtcattccaatgtttaaggaataactgccttgctgcctcaaataagtcttccttccgatccgtcggattcgtgagggtgacacttcgcgtaatatttttccagcttgcgtaccgaatcatgatgagcagccgatttgccatcacttcttttcttcttaaccttgcactcacagattgtgatagcttatcaattaacgcgacaagttcatctggatcgtcagaatcatgaggaagggttgacgaattaccgacggatttaaaatcgtatattctttctgggtctacgatgccgtcatgttcaccattcgccttttgctttaatctcggtccattgatgcccagtaattcctttagtgtatactcatttgctttcgctaagtcttcaatggtgtgaatgccaatcgttttcaatttatctgccgttttttgtccaactccgtgcatgtcacccgctggcagcggccatagcatttggggtacatctcgtttacgcaaaatggtgatgcccattggttttttccaattagacgccattttcgctaaaaatttattcggtgcaatgccaatacttgaaggaagcatgagctcctctacaagcctcgtttgaatatcatgagccgttttcaacgcgtgctcggcatatggcgtatgcgttaaatcaatatagccctcgtcgatggatactggctcgactaaatcgctgtattctcttagtatcgtaaacatctcttgtgaggagcttcggtaccggtcaaagtttggtgtacggacaatcagccccggacaaagccgcttcgcttcccataacggcattggaggctttacacctagcgctcttgcctcatagctgcacgtcaccacaatccctttacgctctttcgcatttccgctaatggctaaaggtttccctctcaaagaaggatcatacgccatttctacattggcataaaacgcattcatgtctatatgaaaaataatatttgacattggcataaccccattttcttcagttcctatattttaatcagaagttccgaatcgatcaaatatgatgaatctcttttatgctcaattatacattgatttatttcatctttcctcaaaaaaaccttctctaaaaaagagaaggtttcacgaattatactttttcttcaagcataccattttgatattgaatagcctcgtatgttaacacttcatttttattgtcattcaaatgtttcacaaccggagtcggctgctgattaaaattcatactcaagctttgattggagtagtggccagctggatcaatataatacttgtaatcaatgactctttccacatcaatgtctgcgtatgcaattccctctgtttcagctggaaccatatcactgatcggttctccatctggaccgtaaatgcacgtatgcccactcttaaatgtgtcaaagtaatctctttgctcctgcgttaaacaaatcatctctttcatttcttccgtatagattgaagaagtcatcagcacaaaagtttgtgtcgcaatagcataatatctgcttgaaatttcatcatcaaaataacctggccaagatgctacatgcacctgttcattttgagcattcatcgccatcagatctagtggtacttgatgctcccagcacatcaatccgccaagattgccaatgtcagtttgaaaaacgggcatcatgcttccacttccatctccccaaatcagtctttctgctacagaagctctcattttccgatgttttcctattaaatccccatttgggttaaaccaaagttgagctaaatagagggaaccgccatctttttcactgcatgatatacaaacgtacgtttcatttctttttgctgcctcgcttattttttggatagctaagctagggatttcgactgcatttttatataatttgtgatagaactttcttgtatattctggatgaccaataaaagcaaaccaaggataaccaggtaaaaatgcttctgggaatgccacaagtttagcaccatttgaagctgcttcgtcgatcagttcacatgatttctgaacggttgcctccaaatttaagtagataggggctgcttgtaccgcagctgctcgaaacttcgggtaaatacttgtcatattcaaaacctccatttcttctattccccctcattataagataggaacggtgaagtttggatgacaaataccactttatacaaaataaggatttgtacgtaataaagaaaacacttggtcctgttagacatttcacaatgtgtatagtacactgtgagtaatgaaatggatgtgataatcatgattattgatacattcaatgaagtctttttccttgttgaattctttacgattattcttccagccctgacggccatcggcattgcgtttttattaaaagactgccgtatgaacgaacacctcggtggacatcgtttggaagagttggacgcatctttattgaatcgaacagactttctgtttatcatatatgatcgcattacaacttggattagtaaagtcattcgaatgaaacgatcatcaaacgatgatgaagaccattcgcttcctctctctaattaattttttaaaaaatgaggaggaaacgaattgaaacgtttattaacgatttgtacgactttatgtttaatgatgattgcctcacctgcttttgcagcgagtgggcagacaaatgcgagctctgatgggtttttccatcattattttgtccagcctttttctgagctgatcatttggcttgcgaacttcttccatgatgattatggtttatcgattatgttcgtaaccttgattgtccgcctgctgattttccctctttttgcgaaccaatttaagaagcaaagagtcatgcaggagaaaatggcactggtgaagcctcaaattgacgacattcaaagcaaattaaagaaaacgaaagaacctgaaaaacaaaaagaattacaaatggaaatgatgaaagtatacaaagagaacaatgtgaacccgctagcaatgggctgtctgcctatgctgattcaaattccaattgttcttggcttttactcagcgatccgttcaacacctgagatcgcaacacattcgttcctatggtttaacttaggacaaactgatctattggtcgcgatctttgcaggcgctatgtatttcttgcaattttatgttacgcaaaggtttgcgaaacaatcaggcacccagacagaggctgcgctaaagcaagccaaagtgatgggcatgattttcccaatcatgatgctgtttatttcaattaatgcccccgctgcccttcctttatactggatgacaagcggattattactcacagtccaaaccattattttgaatgtcatgtaccaaaaatcaaaatcaaaagctgaggcaaacgaccaagctagcccagctgctgaataaaaataatccccttatcatcagataaggggatcttctttatgccaattcttcttttaaccgcgctggcaattgatcgagatcctcaattctcccaaggaacttatttgggtccacttgtaaaatcatcttgttctctctctccacaacgccgaagaagtattcagaggcttttgtgttcatatgaaatggcttgatctcgctttgctcgatatcgataatatcttttgcatccgagacaagacagcctaccatttgttcgtttaattcaaatagcaataccttggactgctcgttcacatcaagaggctttccgtgaagcatcacgcctgtgtcactgacaggaatgacctctccccttaaagacatgagtccttttatttcttttggaaggttcgatacttcttgtaaataagggaccttctcaattgaacgaatatgttctacactgatgccaaaatcctcttgccccacttggaaaataatgatcttttgcgtgctcacagagtctcctgcctttacgatggatttgtcgtttcttcgataatggcgagaaccatttcagctgttttgactaattcttcaatcggcattttctcatttttcgtatgaatatcttcatatccaacagctaggttgacagttgggacgccgtttcctgcaatgacgtttgcatcactgcctccgccgctcgtctgtagttctgatggacggtcaattttcgcagccgcttttttcgccacttctacgacttgatcgccgtgagagaatttgaagcctggatacatgatgtcaatgtgtacatcggcacttccgcccatttctttagcggttttttcaaaggcttctttcatcttcgctacttgcgcttccatttttgcaggttctaaagagcgtgcttcagcaaggatatcgacttgatcgcacacaatattcgtttgcgttccgccttcaaaacggccgatattcgccgttgtttcttcatcaattcggccaagcggcatactagcaatggcttttgatgcaatggtaatcgctgacacacctttttcaggcgcgacacctgcgtgagctgtttttccgtaaatggttgcgcgtactttcgcctgtgttggcgctgcaacgataatggttccgaccttgccatctgaatcaagggcatagccgtatgccgctgtcatcaactttggatctaacgcttttgctccgacaagtcctgattcctcacctgctgtgatgacaaattcaatcgttccatgcggtaaattcttctctttcagcacacggattgcttcaaacattgccgcaagtcctgttttatcgtcagcacctagaatggttgttccatctgttttcacatagccgtcttcaatgactggctttacaccattgcccggaacaactgtgtccatatgagaagtgaaatagatggtatcagcctcttgagtaccttccagtgtacagatgaggttgcctgcaccgtggcctgttttcgcttttgagtcgtcttccaccacttttagtccaagcagcgaaaatttttcttttaagacttccacaattttctcttcgtgttttgtttcggaatcaatctgaacaagttctaaaaattcgtctaataaacgtttttcattgatcatgatactgctcctcctcttatagcggcatgttgccatgcttttttaacggtctttcttcttccttcctgcgaagcaaatcaaatgagcgaatcaatcgttctctcgtttcagacggcataaaaatatcgtctatcagccctgcctgagccgcttttaatacacttggcttcgtttcaacctcgcgcgaatcaggatgaacgatttcgtctgcgaacattttccccatcacatcaatttctgccgctggccatgcataaacaaaatcagcgcctaagcccttgctattcattgcgacatatgctccgccaaacgcctttcttaaaatcactgtgatttttggaacggtcgcttcagcgtatgcatataaaagctttgcaccgtgacggataattcccgcatgctcggctttctcacctggtaaaaaaccagggacgtctacaagcgttaagatcggaatatgaaacgcatcgcaaaatcgaataaacctagccgctttatcagccgcatcaaggtcaaggctgcctgccagcacctttggttgattggcaactacaccaattgaagccccttgtaatctcgcaaaccctgtgacgatattttttgagaaacaaggctgcgtctcaaagaatgagcctgaatcgatgatggctgtcaccacttgtttgacatcataggtgcgtgatggatcctttggcaagatgttgcctggatcagctgcgtcttgctcactcgttttcgcatacatgacagtctgttgtttcgttggtatgtacgttaaaagtgttcgaaccgcttttaacacgtctttctcatctttcccagtatagtgcacattcccgcttgtctgatgctggacacttgcaccgccaagacggtcaggacagaccgtttctcctgttgccttctctatgactttcggacctgttaaaaacatatgagctgtctgttctgtcatgaacacaaaatcggtcaaggcaggagaatagactgctcctccagcacaagaacctaaaataacggatatttgcgggatttgaccggagtacagcacattccgtttaaagatctgtccgtatccttctaatgataccacaccctcttgaattctcgcaccacctgagtcttttagaccgatgaccggcatctgattcttagctgcgagatccatgagagaagcaatttttttagcatgtatttcgcctaaagaccctccatgcactgttgcatcttgtgcataaacacatactggccttccatgaatgagtccagttccagtgacgacgccatcaccgacatgctctgacatgcggcctgttgcaaatgcttgaatttccatgaaactgcccccgtcaagaagttcatgcagccgctgacgaaccgatagttttcctttgttccggtgcgcagctgcacgtttcacgccaccgcccatgaatgctttttcgcgccatttcgccaagtcattgaacgattcattcattgccatgttcctctcctttcaagggctcgcacaattcaaataacacaccggacgtttctttcggtggaataaatgcaatccgcttcccgctcgcgcctatctgtgctgattgttggagaagctccaccccaagatgatcaagacggttaaggtccgcctgtatgtcacctgtctttaacgcaatatgatgaagtccttctccccttttggttaaaaaggtatgtagtttgctgctgccggacatcggttcaattaattcaatgtgcacatgatcaagtgaagcgaaagacgctttaacctcctgttcaggaatctcttgtatgtctgaaaaatgccagttaaacagctgttgaagaatgcgagatgtattttttatagaaaagaccgcaatggcaatatggtcgatttgattcatccgttcacttcctttgttgatcacttgtcgcatttgaaaaaacgagctagaataaagaaaggtgcgttcgtcgcaaaaaatcttcggttataggggtgcgatatgtctcagaaaatgatgaaattcatggtattgctcatgattagcctgctgctaatatcttcacttttagcaggagcggcaacctttttataagatttcaataaaagcagacaagcaggtgattcgttcaatcaacgaatggcctgtttgtctttggcaagcttttcaaatgaatcgcttgatgttgtaatccatacttttgtcccaaccggaagctggtcaaatagaagctctacatcgtgattatgaagtctcacacagcctgccgtgataaatttcccaatcgttgtttcgtcactcgtcccatgaattccgtatgttctgccatctgttcctcgtgcatcaaatccaatccatcttctgccgagagggttattcttcgcaccgccttcgatattcttttttctgtaatagggatctttcgctttgatcataatggtaaattccccttctggcgttaaatctgacgttttccctgttgaagcaggatatattttttggattttcccttgatcaatataggcaagttcatttgtttgtttattaataatgacatacgggtctcctggaagcgggttttgtccaagcggccagattggtgaaagggacatggtcaatacggtataaattaaaagacgcataggctcctccttttttcattagattgaccaatgaaggaggaactcatgcgtctctattctttcatccctttaaaatagcttttcagtactaaatattgttccatttctccgaggaaatgaaacagtgcagctcttgcctcaaactcttctcttgtttgcggcagcggtagcttatcgaactcttctttcatatcaatgaggcgccttaagaacttatgtgccgtgttccctgggtgaatatgttcacgtaagtctctaatgtattccgcaatgatttgtccatgctctgttgtaatggaaatggacgtgatcttcggaagcacacgctcgatgatttcgaattgcttttgcctcatattgaaataatgataatacaggttttcatgtcttaagacatggttttcaacatcacgatatgcaagagcttttgcttctttaatcaattgatgtgtctctggtatttctttgcctgtccagtcttgtttccctgtcattaagtattgttcgatttcctcaaaaatttttgcaaagttggcttcaatctgttcgctgtagtgtttaagctttttatcaacacttggcatatacaggttcatgatcagtgccacgccaacaccaatcgtaatcagcagcagttcattccaaatgaggtgaagggtaatcccgccggacatgtataaatggaggatgatgactgaacttgtgacaatcccttctttaatgcggagcaatacggttgtcggaataaagacaagcagcatcagaccaattacaaaaggatgatacccaatcagatcgaaaaatagataagaaaataaaatggcaagactgcatgcggcaaagcgggcgcccgatgcaagaagcgaccgtttctttgtcacctgaatacacagaatcgtaataatcccggcagcggaataattttgaagaccaagcagttgcgcaatataaatggcgatcgctgttcctaatgctgttttcagcgttcggtaaccgattttaaacatgatgtgagtcactcttttctgtcttgtttctattcacttattgtgaaatgatgaacttttttactttccccattataatcaaaaaaagaaggagatgttaagtctccttctcttttttctttataatattttttgcaagaaatctttcgcgcgctgtgacgacggtgattcaaagaattgcacagggtttgcatcctctacaattttcccatcgtccataaagatcacgcggtcagccacttcttttgcaaagcccatttcatgtgtgacgatcacgagcgtcattccagattgagccagctctttcatgacctctagcacttccttgaccatttctggatctagtgcagacgttggctcgtcaaacagcatgatgtctggtgtcatcgcaagcgcacgtgcaattgcgacacgctgcttttgaccacctgacaagcggttcggaaaatcatcttttttctctaaaagccctacctttttcagcagatcttcagcttgtttgatgctgtcttccttcgattgattcttcacattcattggcgcatatgtgatattttccagcaccgttttatgtggaaacaaatgaaaatgctgaaacaccattccgatgttctcacgcactttgagtgcattggtttttgggtttgtgatttcggtatcctgaatcgtaatgacaccagaagtcggcttttcaagcaagttgatgcagcgaagaaacgtcgattttcctgaaccagatggtccaatgactgcgacaacttccccttctttaatggtggtgtcaatcccttttaatacttcatttttaccaaaagattttgtgagtttctctatgttaatcatttgattttaacttcctttccaccgatttgccgacaaaggtgagaacaagcacgatgacataatagatgagacccgcaaaaataagcggttcaagataattatacgtgacggcacctgcttgataggctcgtctcatgacatctcccagtccaatgactgttacaatcgctgattcttttgtcagtgtaatcgtttcgttcacaagtgcaggtgaaatatttttaaatgcctgcggaagcaataagtccttcatcattttagcataagggatgcctaaagcaacggctgcttctttttgacctttatcaatggcattaataccagcacgaataatttcagatacgtatgcagcagagtttagtgaaaatgccgcgacagcagcccagtattgatcgatttgaaacccgagaagctgaggcagaccgaaataaataatgagcaattgaagcacaagcggtgtgcctcggaagatggatgtataaaaatccgcaagccaaatgagcggcttaaatacactaattttgcaaagcgttaataaaatccctaagataaatccaagaaaaagtgataccactacaatagaaagtgtgaccttaagcccttctaaaataaagggcatctgaggtattacatctttaaaatctaacatgacagtctccttttttatgccttcatacgaaatcaaaaaataaaacaggaaaaaagttcaacatgagttgaacttttcagcgctttctactggattttcgtgaatgacgctgatccttttcctgacttatttttcatcagcaaaccattttttaattaatttatcaagttcgccattgtcttgcatttcttttaatgatttattaaatttagctgttaagtcgctatttttcttgaatgcaatggctgaaccttcgtttgaactattcaatccaaatgcttggaagtctttttcttttttcaaatatccagcagctactttatcttcaataatggctgcatcaaaacgacctgctttgatttcttgaatgatatcagagattttattacggtcttccacttttaagttatatttcttttgcaaaccgtttgcttcatcctgctgaattgaacctaattgaacgccgactgttttatcttttaagtctttctctgttttcattccgctagatttctttgagacaactaagtttttagcattgtaataaacatcagagaaatctaattgttttttacgtttttctgtaggggtcatgcctgcaaggacgatatcagctttatttgttttaagagctgatacaaggcttgcaaaatccatatcttgaatttctagcttgtagccgttctttttcgctagtgctgtagcaagatcaacatcaaagccgacaattttatctccgtcttttgattcaaatggcggataatctgctgatgtcgccataacgagtgttttgtcatctcctgatgcgtttgaattattagaagaagttccgcaagctgcgagtgcagctgcaagaccagctgtcataagtaataataaccactttttcataagataatgcctcccagtatttaaaatcatgtattgttttgaatatttattcactataatgtattttaaacactttctttttaagatgcaatagtattttgctaaaattattttgattcaatggtcttataaaacaaaaagcagaccgatctaaagaccggactgctttatatgtcatcattcaaacatcacatgttacatttcttcgcaatgctcatcgaatgcagcttgaagctttgacacgacttccattggctcgtgcccttcaatttcatgacgctcgaccattttgatgatctttccatcttttaataatgcaaaggatggtgaagatggcgggaagccttcaaagtattcacgggctcttgctgttgcctctttgtcttgtccagcaaacactgtcagcaattgatccgggcgcttatcataatgaacagagtagcctgcagctggtcttgcaataccgccagcacatccgcatactgaattcaccatgacaagtgccgtgccttctttagacaaggcttcatccacttcctcagatgatgtaagctcagtatagccagcctgtttgatctcttctctcgcttgtttcacaatatcattcataaataaattaaaatcaatattcattgtccgtccactcctttagcatgccaaaaccattttaacaacatcatatcaaggaaaacgcctgcgggcaaatgtgttgtcttttcattccacactttttctgaacatcgtttatacgccgcaaaattggggaaaagtgatgataaagagatgaaagggagaactgcgtgatggcacaattcaaaaaagcgatgctcatttataatggaaatgctggacaaaaaaacatggaaaaagttctcggtcaaacagtacctcttctttctctacatattgatgaactcattcttaaaccaacaaagcagccaaatgatgcttatgaattctgtcgtacaattgatgagacgatagaattacttatcatattaggcggagatggaaccgtgcatgaatgtatgaatggcatcggtggtttagaaaaaaggccaactgtagcgattttaccaggcgggacatgcaatgacttttctagaacgcttggtattccgcaacaaatgcagaaagccgctcaaatgattgtagacggcgtagaaaaaaaggtcgacttaatcaaggcagaagatcgatacttgttaaacttttggggcatcggcctcattgcagacacgtccaacaatattaatgataaggaaaaagctgtactcggcaaaattagctacttcacaagtgcccttcgcaccttgcagcaaacagatccttttcacgtacgagttgaaacagaggaggaaagctgggaagaagaagccgtcatcgttcttgttatgaatggacatttcatcgggacaaataaaattgatttgccgagagcagcaattgatgatggaaaagcagaaatcttaatttgcagaaatacgagcttctctgctctaaaagagatcttttctatgaaccgggaagaactggaggatttcaccggcgacctctctctcattcaagcatccagtattcagatccacacaaaagaggaaatggatgctgatacagatggcgaagtgtatatgacagccccagcttctttagaagtgttaaaacagcatttgacctttattgttccagcagaataaagaaaacgcccgagatcattctttttcgggcgtttttttgatatagcgtctgtataaatattcaagtgcatatccgagcagcgttccggtaagaagagaaattcctaaaaggctattcgctgctcctttaaatccaccgacaagcagcaagcaatacaaaacttgaataatagaaacgattgatatgatcagtagtaatctttcaggatgattgcgtgatttagaaatatatcgaagaaaagcgaacgcaattgctgtgataaacatgagtccaatcgttaaaaatgcaaaaaagtctagtccagacatatcatcgctcctttctcatcatggggaaatccccctctccatagcgggagggggacattcttgttttagtaaacagatgtctgctcgtcaatgccttcaaggatttgtttaatccgttgaagaaacctgccgcatacaagaccatcaagtactctgtgatctaatgaaagacaaaggttaaccatgtctcttgctgcaatcataccatttacaatcaccggacgcttcacgatcgattctacttgtaaaatcgccgcttgcggataattgatgattcccatagattgtaaagaaccaaatgatcccgtgttgtttacagtaaaggtgccgccttccatgtcgctttgcttcagcgtaccttgtctcaccttggaagcaagctcatgaatttccttggcgatgcctttaatcgttttttcatctgcatccttaataactggaacaaaaagagcgtcatcagtggcaacagcaatcgagacattgattgctttcttttgcacaattttatctccagcccacatgctgttcatttctgggaattcctttaagccctgagccactgctttgacaaagaacgcaaagaacgtcaaattaaagccttcttttgctttaaattggtccttgagctgatttcttctagtcacaaggtttgttacatcaacttccatcatcgtccatgcatgcggaatttcatgtttgcttctcagcatatttgccgcaatcgcctgcctgattggcgtgactggcagttcaacatcaccaggcattgtagagatggaaggcgccgcttttgattttgatgactgcacaggctctggcttgaccgcctgttcagtgacaggtgctgccttctcttgtacgccgccgctttcaataagctgtagtaaatcttttcttgtgattcgtccgcctgctcccgttccttgcactgcggctaaatcaatgctgtgctcatcagctaaacgaaggactgctggagagtagcgtttcttttgactttgattctctttttcttgatctgcttcgggagcttcactttgctcaggtgcggcttcttctttcgcactttgctgcgagctgccttctacttcaatttcacagaacacttctcctacttgcagtgtatcgccttcttcagctgatagctttgttatcgttcctgtaaaagatgacgggacttctgcgttcactttatccgtcatgacttccgcaataggatcgtatttattcacatgatcgccaggtgaaacgagccatttgctgatggttccttctgttacactttcacctaactgaggcattttcatttgttcaattgccacttgaaaccctcctctttcttaaaacgccgctagctctctcatttcagcttctaccttatcagggttgaccataaagaatttttccatcgtcggtgcataaggcattgccgggatttctggtccagctagacgtttgattggtgcgtctaaatcaaataagcaatgctctgatatgatcgccgctacctcactcatgatgctgccctcttttgtatcttccgttagaagaagcactttgcctgtttttgatgccgcttcaataatggcttcctgatcaagcgggtacactgttctcaaatcgagaatatgcgcagaaatgccgtcttttgcaaggcggtctgctgcttgcagcgcaaaatggacgcagaggccatatgtaatgaccgtgatatcatcgccttcacgtttcacatctgcttttccaatagggagtgtgtaatcctcttcaggcacttctcctttaatgagacggtaggcacgtttgtgttcaaagaacaatacaggatctggatctcgcaccgcagcttttaaaagaccttttacatcataaggtgtagaaggcatgacaatcttcaaaccaggctggttggcaaaaatcgcttcaactgattgtgaatgataaagcgccccgtgaactccgcccccataaggtgcacggatgaccatcggacagctccaatcgttatttgagcggtatctaattttcgcagcctctgaaatgatttggttaatggcaggcatgataaaatccgcaaattgcatctcagcaattgggcgcattccatacatcgcggctccaatccctacaccagcaatggctgattctgcaagaggtgtatccatgacgcgcgcttctccgaattgctcatagagacccgctgtcgccttaaatacgccgccctttttcccgacatcctctccgagcacaaacactttcggatctcgctccatttcttctttcatcgccagtgtaatggcgtctatatatgacataacaggcatttttcttcccccttactccgcatacacgtaacgaagtgcgctttcagcatcagcataagcagcgttttccgcttcatcagtagcttcgtttacgatttgcatgatttcttttgtcatctcttctttcatttctgaagtcatgacgtttccttcggttaaatacgtttcatattggatgagcggatctttctttctcgcttcaagcacttcttctttttctcgatagcttgaatcatcgtcatcacttgaatgcgcagttaaacggtaagagatcgtttcaatcaacgttggtccttcgcctcttgccgcacggtctctcgcttctttgacagcggcatatacttcaagcggatcattgccatcaacggttacgccaggcattccgtacccaatcgcacggtctgaaatgcgttcacatgctacttgtttgtcataaggtacggaaatcgcgtacttattgttttcacacatgaaaataacaggtagcttatgcacagcagcgaagttagcaccttcgtggaaatcaccttggtttgaagagccctctccaaacgtaacaaagctgacaaagtttttttgatctagtcgtccagcaagtgcgatccccactgcatgaggaacctgcgttgtaacaggtgaagatcccgtcacaattcgatttgatttctgtccaaaatgccctggcatctgtcttccgcctgagtttggatcgtcttgttttgcgaaacctgacatcattaaatcttttgctgtcattccaaatgcgaggacaacccccatatcacggtagtaaggtaagacgtaatcctcttctctattaagagcgaaagcagcaccgacttgctgcgcttcctgcccttgacaagaaatgacgaatggaattttaccagaacggtttaaaagccacatccgttcatcaatttttcttgctagtagcattgttctatatatatcaattgcttgttcatcagataatcctaattcatgatgacgcatgttactcatcttatttccctccttgattaaaaatggatcgctttcccgtcaacagcaagggcagcctcgccaatcgcctctgataaggttgggtgcggatgaattgtctgcccgacttcccacggcgttgcatcaagtacttttgctaatccagcttcagatatcatatctgtgacatgaggaccaatcatatgaatccctaaaatatcatctgtcttttgatcagcaatgattttgacgaatccatcagactccccgtatacaagtgcttttccgatcgccatgaatggaaatttccccattttgacttcgaagccttgctcttttgccgcttgttcagtgagtccaacactagcagtttccgggtgagagtaaacacatttagaaacgagcgtttcatcgagcggctttggatcttgcccagccatatgctccacagcaatcatgccttcgtgtgatgccacatgtgccagctgaagcccgccaatgacatctcctattgcataaatatgtgattctttcgtttgataatgttcattcacgacaatgccttgtttttctgtttggatgtccgtgttttcaagaccaatgccttcaatatttggtactctaccgactgatagaagaagtttttccgcttcaaacgtctgaatgtttccatccttttctgcttgaatcgtcacgagattctcttgctttttgacggtatctggcagtactttcgcatttgtcacaaaggtgatgccttttttagataaaagcttttccatttctttagaaatgtcatgatcctctgttggcaatatgcggtctgcaaattcaatcaccgtcaccttcacaccaaaatcattgagcatagaagcccactcgattccgattaccccgcctccaacaatgagcatcgactgcggaagctctggcagttctagtgcatcatctgatgtaagaatgtgcgtcccatctgcttcaagtccaggcagcacacgcggtcttgaacctgtcgcaatgatgacctgctttggaataagcatttcattttcatctccatttgccatttctacggagatggttcctggcattggcgaaaagatagatggaccaaggatacggccgatcccttcatagacatcaattttcccttgtttcattaaatgtttgacgccgcctgctagtttctctacaatctctgcttttcttttctgcacacttgcaaactgcaaggcgatgccatttgcttcaacgccaaaatcagcagcacgtttgacggtttgatagacttcagcacttctaagcagcgctttagacggaatgcatcctttatggagacatgttccgccaagcttttctttttctacaactgctgttttcaatccaagctgtgaggcacgaatggccgctacatagccgcctgtgcctccaccaagaatgacgaggtcatattcagttgccatgacttgtcactcctttcttcatctcttgatcatttgggtattctttcggagattcttcttcttttaaaatacgaagtgcaccttctgctaaggattgcagttcattttcgcctggatagacgacaacatctgaaatccagtcaatgtgacctctaatacttgatgtaatttgtttgctgtacgcaagtccgcctgttaacacaataacgtcaactgcaccttttaggacagcactagccgcaccgatttccttggcaatttgatagcacatcgcttcataaatcagcgccgcccgttcatcgcctgcttcaatcatgcgctcaactttcacagcatctgtcgtaccaaggtagcccgcaagaccaccttcaccaataatgcgtttcagcatttcctcttggctgtactcaccagaaaagcaaagattgacgaggtcacctgttggcagtgtccccgcgcgctccgggctgaaaggtccttcaccatggagtccgttattgacatcaatgacttttcctttttcatggacaccaatggtgatgccgccgcccatatgggtaatgatcatattcaaatcttcgtagcgcttcccaaaggatgcagctgtttttcttgcgactgctttttggtttaatgcatggaagatgctttttctttcaatcgttggcagccctgaaatacgagcaattggttttagctcatccaccacaactggatcgacaataaaagctgggatgttcaaacctagtgcaatttctcgtgcaatgatcccccccaaatttgatgcatgctggccggcatatccttctttcaggtcttgcaccatttgctcattgacttcatatgtgccgccttcaatcggacgaagtagaccgccgcgcgcacaaactgcatcaaactttgaaatgttcatcccttgttcatgcagcgtcttcaggattgtttctttacgaaatgaaaactgatcaatgatatgagggaatgtctttaattcctcatctgtatgtctcagtgtcgtttcaaaaatagatcgttcattgtgaaacacaccgatttttgttgaagtagagccaggattaattgtgagaatacgccattcttttgtcagcaaaaacaaaacctccgtttcaactcattcttcaaattagcgacgacttaaaatatgttgaccattttgcaggaattgacttcttgatttacgcattctttcaattcgctcctccgccaatcggtctgccgctttataagttggaatggcatcacggtttgaaatttcaatcacgcgttcaatgttttggtaaataccttctacctttttcatcgcacgatctgcattatagccataaagctcatcagctacgttaattacaccgcctgcattgatcacataatcaggtgcatacacaatgcccatttcatgaatcaggtcgccgtgatgcgtttctctcagctggttattcgctgcacctgcgatgacctttgctttcagcttaggaatcgttacatcattgatcgttgcaccaagtgcacatggtgcataaatatcacatgcttgatcataaatatcgtcagggtctactgcttttgcgccaaagtcttctacagctcgttttacagagtctttgttgatatctgtgacaatcagctgtgcgccttcctcgtgcagatgtttacacaaattgtaggccacattcccaacaccttggactgcaatcgtttttccttctaatgaatcggttccaaatgctgctttggcagcagctttcatccctttgtatacaccgtaagctgtaacaggagacgggtttccggatgaaccaaatgcaggagaaatacctgtcacaaagtctgtttcttcatgaatcagatccatgtcttctaccgttgtaccgacatcctccgctgtgatatagcggccatttaatccttggatgtagcgtccaaatgcacggaacatttcttcatttttatcttttcttggatcaccgatgatgactgttttaccgccgccaagattcagacctgctgctgcgtttttataagtcatccctcttgctagacgaagcgcatcttcaatcgctgcttcttcgttttcatacgtccacattcttgtcccgcctagtgctggcccaagtgttgtatcatgaatggcaataatcgcttttaagccagattgttcatcctgacaaaatacaagctgttcataatcgtatcgttccatatatttaaaaagttccattgattattcctcctatgactttcgcttaatttgatgtacagatggcaagtgcaattgaataaagcttactttcagctgtatccgaccggcttgttaaagcaatcggcgccttcgctcctgccaccacagctcccacctttgcatgcgcaaagtagatgagagatttataaagaatgttccctgcttcaatcgttggcacaagcaaaatatctgcatgtccggcgacatcactcgtaatatttttatgagaagctgctgtttgagaaatggcattgtctaaagcaagtggcccgtcaatgaggcagccagaaatttgccctcgcctattcatttgcgccaggcttgccgctgtcaaagtggaatccattgccgggttcacgacctctaccgcagataacacagccacctttggcatgtcgtttccgacagcttgtgctacttgaacagcattgatcgtgatctctttgaacatgtttaaatccggcgcgatgttcatcgcagaatctgtgacataaataaaacgatcaaagcccggcacttcgaatgccgcgacatgtgatagaacactcgccgtccgcagcccgtactctttattcagcaccgcttttaaaagaacggctgtcgtgacatgccccttcatcaatatatctgcatgcttctcgctcactgcctgcacggcaatcttagctgattcttcaggagaatccgaatgaataatatctatccagtcttcattgatctcatgctgtttcaccagctccttcaggttgcgtttgttcccaaccagcaggaagcgagcgaccttgcgttcaattgccattttaatggcatgaagcacttcttcgtcttctgcatgagccacagcagcagttttattctgcaactgggcggctttcataatcagatcgtcaagcttcatatatgcccacctttccttatgctcgggttcatggttttcatatgcaagttctatgccagcttgaaatgcagtgaaatgaggcattttgcatgagatacgtgcatttttttgcaggtaacgtgcattttattgcatgctatcttttgcaagttgatatttatccattttatagtaaaggttacgaatgctaatccctaacgttttcgctgttttcgtacggttgaattgatgcttttcaagggtttgtttaatcaactgcgcttcaaacgcttcaacagcatctgaaagagtctctccctcaaattgactgacagctagttcctgctgctctttttcttcctgctcttctgactccatgaaggaaatatgatcttcatcgatccactcttcttgcggattcaaaaaaatcatggctcgtccaaggacattttccagttctctcacgtttccaggccagctgtaagaccgaagtctatcgagcgcaccttctgttaagccgctcacatttcgaccatagtctaaattgattttctgaataagacgtttgcttaatgagtcaatatcttcaaggcgctgccttagaggcggaatggagatcggatatctgttcatccgataatataagtcctctctgaactttccttccgccatcgctttttcaatgttgacatttgttgcagtaatcacacgcacatcaactggtatcgcttttgttccgcctactctcacaatttctttctcctgcatgacgcgtaataattttgcttgtgtacttggcgtcatttcaccaatttcatctaaaaagatactgccgtgattcgcttcttcaaacagccctttcttcccgccgcgcctcgcaccagaaaatgcaccttcctcgtagccaaaaagctctgactctaaaagtgtttctgataaggcagcacagttgactctcacaaagcgattatatttccggtcactttcattgtgtatagcgtgcgcaaatagctcttttccagtacctgactctcccctgagtaaaatggtggctggtgttttagcccctagctttgcctgctcaagcgccacaagcatttgctcactttctccaataatgtcttcaaaagtgtactttgcctcaagtgttcggatgagctgtcttgctttatttaattcattcgtgagtgattgaatttctgatacgtcatgaatgacgccgacactgccttttaaaatgccatcaacgatcactggtgctacgttgacaatcacatccttcttattaggtccgactttcattctgacgcctcgaactggccttcttgtttcaagcacctttaaatgcatgctttccccttcagaaatatccgcacccgcaggtttgcccacaacctctttgtctgttaatcccgtcattttcgtataagctcggttaattaaaattcctttcccctgctcatctacgacggatatcgcttcatctgatgattgaatgattgcctcaagcatcgtgcgcacttctttgagatttgtgacttcttctgcaagttccactgcatctgtaatatctttaaaaatggatagagcacctagcattcttcctgcgtcatcaataatcggcaaacgcgttgtgacaatttgtatttgctgattcagaaattgtttttgatgaaattctggctccctcgatcttaaaatatcggggagttttgtatttgggatcacttcacgtatgtgccggccaatcgcatctttttgcgaacgtccaaccattttggcagccgatcgattaaacagaacaacttcttcatccatattaataaaaatcatgccgtcgttcgttgcattaaaaatgcggtcatgtttataggtttgttcttttaatatttgaatgagctgatgcttttctgacattaattctgatatgacatatgccatcgaacttggaacaatgacagactgctctgctttttcttccatcagttctttaaggacagctgaactgcccgttgtttcaatgatgatatcaatgtcatcttttatgtattctttccaatccgttgtcgtatcaattccattttttttcgcttctaccatccccggtgccccaagatcaaggtcggcgattgcaacgatttgaatcatatttgttttcagcaatgtttcaagcaatgctgatccaccctgtcctgcaccgacaatcaagactctctgcatcccgttacccctttatatgaaaaaatttgcacaccatatttttccgttgcaaaaaattgcacaactcttatattaccacgttttcctttcttgacaaaatattttttgaattagacaatggaagtaaatgacgtttaaggggacatttgatggagagaatacttgcattagtgattattttaatacctggcgcgcttgctgcacttggaattaagcttttgcgcgacactgttttcggtatcatcatctcaccatttccatttttatggctgcaaggaattgcagggttattatttttaggcggaggtctttatgtagttgctggctttattttatatagagaccgcaaacgcaataaagtgactactcgctttaagcagtgataaacacgaaaaaagacccgctgacgacagcaggtctttatttcatttcttctcttatttcgacggctctatcaggaaaatctgtgaaaatcccatcgacacctaaggaaaacatgtttttcatttgcttttcactgtttactgtaaatggcctgatcacttgctgggcagcatggagagctgatacgacttcttttgttacccctgcgccctttaaattggggtgataacctcttgcaggtactgtttttatgtacatctctggctgatgaatgacatccattgtgagaacagcaagctcaacatgcggcatcagcttgtgaaaaagagctaaactgccgtgatgaaacgatgagactagtacacgatcttctatttgaaaatgttcaatttgctcttttactttctcttcaataccaggatatcgataaatggagtttttcagttcaatattgatgatgagagatgattgctgcgtcactagctccaatacttcttctaaaaggggaatggatacagcaccggtttcttcataaaaagaatgactcgcatctcctgcttttaactcttcatatgtatggtctttcactaagcctttcatattggttgttctattcagcttctcatcgtgaataacagcaagcctgccatctttcgtcaactgaacatccagctcaattccgtcagccccagaatgaagtgcatgctcaaaggctatcatggtattttcaggatagatgcctttaaaacctctgtgtgcaaaaattttcgtcatatgtcacctctaagtatgatgcttcctttcattatgacgtctctcttttcgtttttccagtttgagcacataaaaaaacctcttctgattcgtacgaagagggtctgtataaattcgatcacgtaatcgctctgatggcttgctctgtcgtctctgcgtcaagagcaaaaagggaagaaacaactgcgactgctgtaacaacggttaaacctaacaacaactttttcataagataacctccactttcttttgaagtatttgtgcatcgaatttcttttcaagaaaacgtatggcattttgatagtcatttcgttccttgaagtatttcgatatttgttcagacaaatcctcaagctccacatataatctatttttttctatgtagtctaatttttcagagaataagtctgctgctccactattttcgcacatcaaatctaaaatttcaaattttactatatattcattattttggatatcacaactatactgaatgccctctttaatatattccttcgcctcttgatctcctagatgaaccaaggcatttgccagaacatataaagattggatgtaataatggctattgtcacggtgcatttgaatgcccatcccttttttggcatattgtgcgctgttttcgtaatcatgtttcgcataataaagaacggctaaattgtgatagcatttcccaatcagcacttcattgttaatacgtttacttttctcaagtgcttcttgatatttttcctccgcttcgtcaaattggatcaaatcgatacaattacttgcatgtaaaatcaagctgtcaatcgcctgcgctgtatattcttcatgcgctttgaacgtatcgatggcttttttgatatgattaatggatatgaaattttgtttcagttcgtaataaattgaagcaaccttatgatgaaaagtccctacttcaaggtcctcattcacacgttttagacgctgttctgcaattttgtaaaagctgatggcttcatcatattttttcacatatgcagcatattgacctttgtaaaagtaaaaataaaaattaataatgtcatctactttctcatcaagcgttccgacactcttcataatgtgattggctttttcaatatttccaagtaacatttcatgtctgccattaacaagctgataatacaggagaacttcgcggtcttcatctgtattttttagcaaattctgaattttctctttatagatcgcagatttttctaggtcattttgagaaatgaccctcgtccacttgctaatttcgttcgctacctcagcagagtggattttcagctttcccataacctcaccctcttcttttcattattatagcatagtaaaagaatgtgaaaattattaaattcgacaatgggaatattcagttcaaatggcacaatctctaagaagccagtgactttaaaacgccaaccaatcaggtcaatagcaatagaactttcgatctcatttgctttatttaccaaattcatcagaccttttcctctcatcctttttcttacgaatgagcgtttccttctactattttgaagaccaaacaattgattggcgtagctgattaccactaatttatgtcatacccatttctttcatgctttattattcattttattctgaaaataaatcaagctgagttgtccaaatgaaacaataagatgattgtatcaatacaaccaattttttacaatatttttcaaaaataaaaaaacgtctctttgaagaaacgtttttctataaaaatgaactagctagctctatgctccaagcgcagacggtcagccaccattgcgataaattcagaattggttggttttgctttagacatgctgactgtataaccaaagagtgaggaaatggagtcaatgtttcctctactccaagccacttcaatcgcatgacgaattgctcgttctaccctgctcgcggtcgtgttaaatttcttcgcgatgtctggatacaacacttttgtgatgcttccgagaagctcgatgtcattgtacaccatcgaaatggcttctcttaagtataagtaacctttaatatgagcaggtacaccaatctcatgaataatcgtcgtaatgctcgcatctaagtttttacgcttcggttcaggtttatttctaagaacactgttttggatagatgaagatcgatgggtgacttgtgtgccgtttccactgacttgacgaatatgaccgactaggttttccatatcaaatggctttaagatgaaataggatgcgcccaaatcaactgcttttttcgtgacatcttcttgtccaaacgccgttagcataatcacactcggctgtttggtcatgtcattgttttcacggaggcgttccagtacagcaaggccatctaaatgaggcatgataatatctaagaggagaacgtcgggctctttatctttaaataatgtcagacattcctgaccattatacgccacgccaagtacttccatatcttcctgtccctcaatatactctgtcaaaaggccaacaagctctcgattgtcatcagctacacacactttaattttctccacgttctttcctccccaatgtcgattcctttagtcttttgtatttctcttctgagtgttcaattcgacaaaaccatgctatcccctttaaaaaactttaattttccgaataatagagcattatctagctttttctacgtttttcttaacgaatcgacgattattgcaatttgacaacataccatttttcattttgtcgaaaaatctctttttccttattttataacatgatgacagagaaagaaagaggagaaaaaaactgccggaagattcgcggcagtttgatgatcagcttgcttttttgtttttttgataaaggtcaatgcctgcttctgacagcatccattcaatgtgtacgccgtagccgcttgtcgggtcattgacgaagacgtgtgtgaccgccccaatgacttttccgttttggatgatggggcttccgctcataccttggacgataccgcccgttttacttaaaagacgctcatctgttacctttaataccatcccttttgttgccgggaatttctgcggagtcgtgctgacgattttaatatcaaacttctcaaccttatcatgatccacaacggttaaaatctctgctggaccttctttcacttcatttgataaagcaactggaagcggtttgtctgatacatgattttcaagcttttcggttaacgtaccaaagataccaaatggactgttgcgggagatatcccctatcgtttttcgttcggaagagaatctcgccaatttttctccaggattgcctcctgtgcctttttcaatcgatgttacggttgatctgacaatttcaccattgtcgacaacaattggtttttttgtatccatgtcagaaatgacatgcccaagggcaccatattttttagaagatggttcaaagaaggtcatcgtgccgattcctgcggcggaatctcgaatgtaaagaccaattcgataggtgccttcacttgcatcttttgcgggtgttaatgttgtttgaaaggttttatggtctctttttatgagtaaacgaagcgtttcacctgttttccctgctttctggataaatggggtgaggtcattcattttctccatcttttgaccattgatttcaatgatcatatcccctgattgaatgcctgcggcttcgcctggtgattttttgccgtctgctgttgtgatttgatgaaaacctacaacgagaactcctacagagtggagcttgacgccaatggattgtcctccaggaacaacttttaattcagggagaacgtcgacttttgttttcttaataggaaatcctttaaaatcataaacaatttcggcttttcctgccttttgtcctgttacttcaagctgattctttttctctgaaagactaaaggcttgtgaagaagcattggctgacgcttctattgatgtgtcaattgcgtgcttctgtttttcaaatacagcaacatttgttggaatactgatgtattccttcactatgctcataaaccctgtacttattaaagaaacaaggagaatcacaccaatggcttttctcatcttttcgggcattcatttttcactctcctcgctccttacccacaccagaacactcatgttttggctacatctttacttttgccttcttcgctttgatttataaccagcagctatagaaaatgattggataaattgataaaagaaaaagacgaattcgtgggtatatacagcgattttgacacaatataaaaaaggcagctggtttttcagctaccctgttgttttgacatcatttgcttgatgcagcaattcttttgcatgctgttttgtcagctcagtgacttcgacacccgcaatcatcctgccaatttcactcactttttcttcatgacttaatggtttgacgtttgtcagtgttctaccagctttagagcgtttcgaaatgaagagatgcgtgtcagccattgctgctacttgcgggagatgcgtaatgcagagcacttgtgagccagccgccactttataaattttttcggcaattgcctgtgcaactctgccgcttacacctgtatccacctcatcgaaaataatggaagtgacctcttgtttggctgagaagatacttttcacggcgagcataacacgtgaaatttctccaccagaagcaacttttgataaagatttcatcggttcgccaggattagtagaaatcacaaattgagcttggtcaattccgtttttcccaagctggacgggctttccatctagcagcggattatccgtgctgctaaaaggcgcataccgaatggaaaaggatgtatcaaatgttgacttctccatatacaaatcctttagttctgtttgaatttgcttcgctagctttttggcccattttttacgaagctccgaaacgttaagtgcttcaagcagggcgtcacggctcattgcatccagtttgtttttaagtgtctgcagatgactgtctcgattttgaatttgatcgatttcttcttcaatcttcgccgcatactccaaaatttcctcaaccgtcgtcccgtactttcgctttaactgcttcatttcattcagcctagactcaataaaatcaaggcgtgctgggtcaaactctaattgatccagcatgcttcgcatttgaaacgtcgaatcctctaataaatagtaagagttcgacacttgttcggaaagcttttttagatcgtcgttaatctcagaaacctgttcgagctcgctcgatgacatgccaacccaatcaagtcccccctgctcattgcgcaaggcattataggcgttttggagtgaggaaaagatcttttcgtagttgctgatctgatggcgctcttcttgaagcttctcatcttctcccggctctaattgtgccgcttcaatctcttctagctgaaattgcaataaatctaatcggtgcaccatttcttgctcattctcagagagctgttttagcttttgggctgtctttgtatattgctcatatgcttcttgatactgtgacaaagcaggtgcaatttcttctgctccaaattgatcgagtaaatgcagatgattttcatcctccatcaataactggttatcgtgctgtccatgtatatcgagcaaaaggcgtcctacttcgcgtaaaagtgagattgtgacgagcttgccattgatgcggcaaatgcttttcccgttattgttaatatcacggcgaaggatcatcatttcatcagttgtgtcaattccctgctcttcgcataaagcaaatacagggtggtcagctgctggtacaagaaaaagcccctccagctcagcctttttctcaccataacgaacaaattcagacgaccctctacctcccacaagaagtgagacagcgtcaatcatgatggatttccctgcacctgtttcccctgttaggactgtgagtcctttttcaaatgaaaccgttaactcttcaatgattgcaaagtttttaatggttagttctgctaacactcatttgccacctctttttgtaaacctgattctttataggagctctaaaattttgcttgaaactatttccgtatcatctggtgtgcggcaaatgatcaaaatggtatcatctccgcaaatggttcccatgatttcttcccaatctaaattatccattaaagccccaatcgcctgagcattacccggcatggttttgaggacgattaaatgactggcagcatccattttaataaatgcatccattaaggatcgctttagtttagacagcggattaaaccgctgatccgcaggaaggctgtatttatatgttccattgttcgtcggcactttcactaaatgcaattctttaatatctcttgaaacggtcgcttgtgtaatgttatatccatcggcttttaaaatatcgactagttcatcttgtgtttcaatctcttggctcgcgatgatttctctaatcttaatatgcctttgacctttattcattattgaccccctaggcgtttgatctcagtttttctttacgttctatgttatatgaaccacagttcaaaaaacaagcgttacgtgagaaacggccaattctcatcttttgaccatgtaaaaaggaataatagcgagctattattccttttgtttcaacctcatgtatcagccggctcaggactgtttttcttttctttcaatacagaataggcttccttgacgatcttttcaagttctgaaactggaagtgccgcattctcttcttgatcagggtgaagcactaaatggagaaggaactcaatattcccgtctccgcctgtaataggcgaaaatgagacatccttcacatcatagccttcttttgcagcaaattgattcatctcttccagcacaccaaggtggacagacggatctcgcacgatgccttttttcccaacaagctctcttcctgcttcaaattggggcttgacgagtgcaatacagtctccgcccggaacaagaatgtgctttaaagccggaagaatgagtttaagtgaaataaaagagacatcaattgacgctacttctggcaatccttcggtaaaatctgccgggacggaatgacggaaattggtgcgctccatgacgattaccctgtcatcctgccttaatttccatgcaagctgattgtagccaacatcaacagcatatgatttgaccgctccattttgaagagcgcaatctgtaaatccacctgttgatgaaccaatatcaattagcaatttcccttcaacagttaagtcgaattcttttagcgctttttccagctttaatccgccgcggctcacatatttcagagggttccctttcacagtgagcggtgtatcacgagcgattttctctcctggtttatccaaacggttttcatttgagtaaacgatccctgccataatggcacgctttgctttctctctcgtttccattagtccttgttcgactaataaaacgtcaagtcgttctttctttgatgtcatgatccaattccttttcttggtgctgcgggaagcaagtcacgtaaagtgtcagcaacctgtgctttcgtcaaaccaatttcttcaagcagggcatcaacacttccatgctcaataaattcatctggaatgcccatacgttctactttgatatgagatgctttcttatcgtgtatatattctaaaacgctgctgccaaatccgccttggagcacagcttcttcaatcgttaaaatcggaataccttcagaaagaatatcatttaacatcgcttcatcaagaggcttaataaaacgagcattgacaacacgaaccgatttcccttctttttgaagttcttctgctgcttgaagcgccattttaatcgtcgtaccaaatgttaaaatcacagcatccttccctggacgaagaacctcccaggacccaatcggaatggttttcagctgttcatccattttgacacctaacccattaccgcgcgggaagcgcatggcaataggaccgtcatcgtactgaatagctgtattgaccatgtgctgcccttcattttcatcttttggcatcatgagcaccatattcggcatatgacgcataaaggcaatatcaaacacaccttgatgggtttctccatctgcaccgacaagtccagcacggtcaatgccaataaagacgtttaggttctggcggcaaatatcgtggagcacttggtcataggctctttgcagaaacgttgaataaatcgctaaaaatggcttcatgccctgcgtcgcaagaccagctgccattgtggctgcatgctgctcggcaatgcctacatcaaacatccgctgtggaaattccttcgcaaagccttcaagctttgaaccaacaggcatcgcaggcgtgatcgcaacaatccgctcatcttcccgtgccagctttctgactgtttcactgacgagaccactccaagacggagctgctgctgccggttttacaaaatcacctgtatcaattttgtatggacccgtaccatgccaagtgccaattttatcggattctgccggctgatagccttttccttttttcgtgatgacatgcagaagaacaggcccttttgttttctttgcatattcaagattctcaaaaagatcttcatacgaatgtccgtcaacaggacctaagtaggtaaatcccatttcctcaaagaacatgccagatacaagtaaatatttgaggctgtctttgatacgctctgctgtcgcagcaagcttaccacctacagctggaatgcgcttgaataaatattcaagttcgtcctttacccattggtatttgccagctgtacgtaatctgccaagcattgtgtgaatcgcaccgacgtttggtgcaatactcatttcattgtcatttaagatcacaatcatatctttcttttcatcaccgatatgattcaaagcttccagcgccatacctccggttagtgcaccgtctccaataatcggcaggatatattcatctgtccctttgatatcacgcgctgccgccatacccatcgcaccagataatgaggttgaactgtgacctgtctcccaaacatcatgctcgctttcatttcgtttaggaaaaccgcaaagccctttatattggcgaagtgtatcaaactccgcccctcttcccgttaacagcttatgaacgtaagactgatgtccaacatcccagagaaatttatctttcgggctgtcaaatactttatgaagcgcaacagtcagttcaacgactcccaggttcggaccgatatgcccgccagagttagctaaggactcaattaaaaacatgcgaatgtcagcgctaagctcctctaattctgcatttgacattccctttagaaacgttggattttttattgataaaagatccaattaggatcaactcgctttcaacaaaatttctatatacatctataatgccttattcctttgaaaaccagtagggaataagagttgtctcatcataataaactgtttacagtttaccacaattgctcgaggaccctcaaatctaggctgtttttaatgatctcttgaggcaattagatcacataaatcatgcagtaattgctgctctaattgaagattggagacaatttcttttgcacgtgtgatgtgctcatgcagtttttcttttgctcctgaaagcgttaataaagaaggatatgtcgacttttcatttgctgtatcagagccgacccgttttccgattttttcttcgcttccttcgagatctaaaatatcatcacggatttgaaacgcaatgccaatatgatagctgaattcccttagcttctcgatatcgtcatctgatgctcctgccagcattccacctgctgcgacgctgaacgtgaggagctttcctgttttacgggcgtgaatggattctagttcagcaagcgatacttgtttttgctctgcttccatgtcatcaaactgaccgccaaccattcctagtgcacctgctgactttacaagctcatctacaattctgatctttttgtcagcagagacgctgcttgacagctgtgatgtaatcaaacggaagctctctgttaaaagggcatcacctgcgagaaccgctgttgcttctccgtacactttatgattcgtcggttttcctctgcgaaggtcatcgtcgtccatgcaaggaaggtcgtcatgtatcaaggaatacgtatgaatcatctcaaccgcacagccgacaggtataccgtcttcttcgtttttaccgtaagcatttagaagagcaagaacgagaacaggtcgaagccttttcccgcccgctttaattgaatagagcatagaagatttcaggtcttctggaatcgtcaattcctgaacatatgtaaataaataatcttcaatggcctgctttcgtgttgttaaaaattcatttaaattacttgtcaccagcatctgcctccttcactgagaagggagccagctcaccgtcctcttttaaaatgaaatccatttgcttttcaacatgctgtaatttttcatgacaaagcttcgaaagggtcatgccttcttgaaaataatgaatggcctgctcaagtggtacatctccttcttcgagctttcccacaatctcctcaagacctttcatcgcctcttcaaatgtcatttgttcttctttttgtttattggattctgtcatgatgattgcccctccttctcaataacctcacaaattagacgtccatccttcatcgtgatagtcagctgatccttcgtctctacttggttcacactttttattagttcttcttctttataggctaagctgtagcctctttccatcacttgaagtggatttaatgcatttagtttaccaagaaccgattggaactgcgaatgaattgttttcatttgcacattcatactgcgaatgagctgttctgtttcattggcgtgtcgttttttcgcttgaagcagctgttctttaggatgaagcggcttcagtctgtatgtctggcggtctagctgactgcgtttttgctcaatttgtctcgtcagctgtttttgaaaacggtcaaataccaaatcgaattgctgctctttttgctcctgtaatcgttttggaaaacggaaggcataagaggattgcagcgccacaagacggtctttcgcttgtgaggttcgattctttaccgctcttgttagccgtatatcgattgatttgattcgctctattaaatcggtcgtgcttggaacagcaagctcggctgctcctgttggtgtgggtgctctcatatctgcagtgaaatcactgatcgtaaagtctgtttcgtgcccaactgcagatatgattggaatgtctgatgcgaagatggcccttgcgacagcttcttcattaaaagcccaaagctcttcaatcgaaccgcctcctcttccgacaatcaagacatcacagagctgtttttcattcgcttccttgattcgctctacgatggaacgggtcgcatgctcaccttggacgagcgccggaagcacaatgattttcgcctgctgatagcgccgattgatcgtcgtaatgacatctcgaacagccgctcctgttggagacgtaatgacaccaacaacctctggatattcagggattggctttttatagcgcgcatcaaataagccttcacttgctagctttttcttcagctcttcataagcaagatgaagagcaccaacaccatcaggctgcatttcttttgcatataattgatagttgccgcttggttcatagacttgaattccgccgcgtacaaacaccttcatcccactcttaggtgaaaaaggcagcttcgccgcagagcgctggaacatgacagcttgcatgcgggcgttttcgtcttttaaggtgaagtacacatgtccccttgaatgaatcttgacattggatagctcacctttgatccaaatatcttctaaatgcggatcaacatcaaattttctttttatgtattttgtaagggctgtgaccgtcacaaaggctttttcactcatgacgtattcctcctcctcaaaaacgcacattcatccaccagcagtatgcaggtggatgaatggataaagcttatgctaatgtacgttttgctgatttaaccgtattatgtgcaagcatcgtaatcgtcattggaccgactccgccagggactggtgtgatataagaagctttttcttttgcctcttcaaaatcaacatcaccaacaagcttcccggtatccaaacgattgactcctacatcgatcacaatagcgccttctttaatttggtcagctttaataaagtttgctcgaccgacggcaacaactaaaatatccgctttcaacgtatgttctgaaatattcgctgttcttgaatggcaataagtaaccgttgcgttttcgtttaacagcaattgtcctactggtttaccgacaatattgctgcgtccgacaacaacgacttcttttccagaaagactaacacccgtcttgtttagtagttcaacaatgcctgctggtgtacatggaaggaatgtgtcttccccaagcagcattttcccgatattcaatggatggaaaccatcaacatctttctcaggtgaaatacgttcaatcacagctttttcagaaatatgttttggcagtggaagctgaacaagaatcccgtgaaattgatcgttcgcattgtactgatcaatcagctgaagcaattcttcttctgttaaagaagcatctaaatgatctagctgaaaatgcatccccattgcttctgctgcttttttctttccgcgtacgtaagaaagtgaagccggatcatcaccgattagaataacggcaagaccaggtgtgacacctttttgttttagctcttctacttcttttgctaattgctcacgcttttcttttgctgtttctttcccatcgatgattgttgctgtcatgtcgaatcctcctattgctgctttaggtcgtttttaatgtttgaaagtactccatttacaaatttcggtgctttatcatcaccgaataatttggccagttcaatcgcttcattcattgagacactaaccgggatatcttcttgatacaccatctcgtacacagacagccttaaaacggctctgtctacgtttgcaatacgatcgagtttccaattcactaaatgctgtgaaatcatgtcatcgagcttgtccttttgttcaagcacaccgaaaaccagctcctcaaaaaaaggatctgattcttgttcgtccagcgcatgtgtaatggcctctttcggatcaatattgctcacatcaatttgaaataatgtttgtagcgccttttctcttgcagttcttcttttcattatttactcctttaaccactttatccgcttgtcgttaagccatacagagatcataacatattttgaccgtggtcgcaccaagatccatgtgagctgtcacgaaaaacgaatcaatccacgtgtgagatcatcattattcggaaatgacccaaaaatgggctttaaaaaaccaaagaggcgatgcctccttggtttcacttgaactcttttttacatttcttgatctacttcagcatcagctgattttgtatcaaattgaataccaacgacatggatattgatttcattaatcgttaaggcagtcatgttcaaaagagtttgacggatattttcttgtacagcagtggatacctttggaatggataggccaaattcaatcacacaatatacatcgattgtgatgccttcatcagagacatctactttcacacctttacggtgattttttttaccaaagcgttctgctacatcagcagcgaaattgccgcgcatttcggcaatgccttcgacttctgaagcggcgatcccagcaatgacctcaatcacttctggtgcaatttgcacttttcccaattgatcttcatcaaggttcatttcaagcaaattgttttctgacacgatcattcacctccgaaagctgtgattatttcatgatttggtatgtttctaaaaacttcgtattaaaattaccgctcacaaatgtttcatgctcaagcaatcttagatggaatggaattgttgtgtagactccttcaatgacgaattcttgaagcgcacgtttcattctcgcaatcgcttcttctctcgtcttaccatatgtgatcacctttgcaatcatactatcgtaatatgggggaatcacatagcccggataagcggcagaatccacgcgtactcctaaaccgcctggcggaagatacattttaatttcaccagctgatggcatgaagtttttctctgggttttctgcattaatacggcattcgattgcccatccttcaaatacgacatcctcttgtgtaagagaaagcttctcacctgatgccactttaatttgttctttgatcaagtcaacgcctgtgaccatttctgttacaggatgctctacttgaatacgggtattcatttccatgaagtagaacttctcttcattataatcataaataaattcgactgttccagctccagtgtattcaacagcttctgcagcttttacggctgcttcacccatttgctcacggatgtctgcatttagcgctggtgatggcgtttcttcaagaagcttttgcattcttctttggattgagcaatcacgctctcctaaatgaatggtattgccatgctgatctgcaagcacttggatttccacgtgtctaaagtcttcaatgaacttttctaaatagacgccagggttaccaaagttttgcgctgcttcctgctgcgtgatggtgacaccgttaatgagctcttcttcggtacgagctacacggattcctttaccaccgccgccggcagttgcttttataatcacaggatacccaatacttgctgctgttgaaacagcatcatcaagatcttttacaattccttgagaaccaggaacaatcggaacgccagcatctttcattgtttccctcgcgacatcttttgttcccattttggaaatcgctgacggagttggcccaacaaagatgacattgcattccccgcaaagctcagcgaagtctgcattttcagcaaggaagccgtatcctggatggatggcatcagtacctgttaatttagcaacactaacaatattcgtgacatttaaataactatcttttgaagcagtcggtccgatgcaatatgcttcatcagccatttgaacatgaagcgcatcgcgatccgcttccgaaaataccgcaactgtttcaattccaagctctttacaagcgcggataattctaactgcgatttctcctctgtttgcaattaatagctttttaatcatgatcgtactccttactctgctttcactagaaagaggggttgtccgaattctacaagctgaccgttctcagctaatacttcgacgatttcaccttttacttctgcttcgatttcattaaacagtttcatcgcttctacgatgcacacaactgtgttttcgttcaccttagaacctgttgtcacgtaaggacctgcttctggtgaagatgaagcataaaatgtgccaaccattggggatgtaattttatgcagattatcagacgcagctgcctcttgtgcaggggcttcggtctgagctggagcttgtgctttaggagcttgttgagctggagctgcttggacaggagccactgatgcttgtgccgcaacttgctgaacgacttctttatttttcttcagtttaatttttgcaccttcgttttcgtacgtaaattcatcaatagtagattcgtcaattaatttaatcagttcatgaatttcttcaatttttaacatggatttgcacccctatgtatggatttatctttttctttataggctagtactaaaagtacatactataaccatcttacaggaggatttcaatgaattcaactactattgtggcgaagcgctttgcgagagcatcttgaagagggcgcaaaaccgcatcaaaaaacgcccttttcggcaaagggcgtctgttcattttttattcgttagagggctcaaaagtgaccgctacgttatcaagacctctcatttcttttgtgaccatatcaataatatcggccgcttgggactttgattttttgtcagaacgaactgtgatgctcactttatctccctctgcactcactagcgcatctttataaccttttgttttaattaaggtttcaagttgacgctccgttccttctgcttcactaagcgctgtcatttggtcataagcttcgcttttttcttgtgctgttgcatcatcactggatacgatttcgttgaactcttcgcgctgcttgcttcgtttatcttcaagctctaatctgtatgttgtaaaaagctcatcgtctgtttgctctgacacaacctttccttcttcaccgcttgtttcgatatcctcttgtttaccatttgtttctttgtcagtggacttctcatcagcgcctttttctgttcctttatccattcctttttctggttcagtctttttctcttccgttccttttgatttcatctcttctactgtcactgcattttcaccttgtggagacatgatatagtacacacttaagacgacaactaaacttagcatcgttaatagccaaaccgtttgtttttttaacatcattccgaatcctccttgatttttttaggggcaacagccactctatggctcggtacatcaagcactcgtgtaaccgcttcaatgatggttttctttatttgaacgttgtctactccttgagcaacaacgagaacacctcgaatatctggttttttcgtttgtaccacaactggcgtttcttcattgccatttttgatgatgacgatttcttcttcttttgtttgatcagtgacacttcgcacgccgccttctttatctgtttcttcggtcgttgtgcttttattggatttgtttttttcaaacacttttaaagaagttgcgtctacattgaccacaatcgatacatcctcaacgccaataatggtctctaaaatttctttcagctgattttcgtattcttgctccacatcctcaatcgaattctttgatttacttgacgatgccggcttgaatacctcctgctcttgtgaggttgtttttttagaagcaggaacagcagcttgttctttgcttgatggcggtgacaagatctgactgactaacatgaaagatacgccgatgatgaatacaagcagcaagtaatggtgcttcgttaattttggtttccctccacctttttcaggcggctgcaagaatgatttcagcttttgtttccagtccttgttattcatgatctgctgcgtcacctccctcaatgttcagcgcaatgtgctcaggactcgtattccaaacatcagcaagcgtctctttcaccctcttgatctctttgctagaagatccagcactttcctccttttgcctggagagatcaatgtccacctttgccaccgtttctacagcatcacctgtgagcggggaaagaactgctttgatgcgaaattgatccgcctccatattctgatccaggtgctcaacatctgcctgcacttctacgtgtttcatttcatagctctccttctccagtggctcctttgcgcttttttctagttggacagccatttgctttaaaatatatgcacgctgagaggcttgtatttcttttttttctaaattcatctgattttttatttcttctgactgtgcttcttccttccccttcatcaattctgagaagatttggtcagggtctgcccgaaataaagcaaaaatcggattgagcatcacgacaatcaacaggaggctgacgaccattttggcatatttttgcatgcttgaattgggaagcagaagatcaatgacaatcgcaaataagataaagagaataatacttgtgatccattccgtgagaaaactcaaaaggtgtcccctccttacttcatcatcatggtcaaattgccagcagtgataatgacggtaatgcttaaaaagaacatgagcgatacgacagcaagtgcagcaaagatatagagcacactttttgaaatgacatcaaggcagctgataatcggaccgcctcctaatggctgaagaatggctgcggcaagcttatatataagagctagcgagagcactttgatcgcagggaaggcggcaattgaaatgagaatagcgacgccgacaagtcctaccgtatttttaagtaatacagaggcactgatgacggtatccgtcgcatctgtaaacattctgccaaggacggggatgaaatttccggtaataaatttggctgtacgaagtgtgataccatctgtaaccgcagcagatgccccttgcacagaaatgacaccaagaaagacagttaaaaaaacggctaacccgcctatcgccacatttcttaacagctgggcaagctgggtaaccttgtattgttcagtcagcgtactgacaatgcttaatatcgctgataaaaaaataagcggaagaacgacatattgaataaaaacgccgctcgtattcatcaaaaataagataaccggatgaaagaatccggctgagacaagcccgcctgaggaagcaataagtgctaataacagaggaataagagcaagaataaaactggtcatcgtttgaatggcttccgttgcataagaaatcgccacatgaaagctgttgagtgcaataatgatcagcaccatataaacaagtgcgtatgcgactttactgacagtgctttgttcaaatgcattctgcaaaagctgtaaaagcgaacaaaagatggtgagtaaaatcagtgtcccaaggagctttccgtttgcgatgacctcgtgaaaaagataatgaacaaaggctttcagccatgtcttgggagacagctctttatcgccatcaatcatttctttcactgttcctttttggctttctggcagaaagccgccatactcatccaatatggtttcccaaaagtcactaatggaatgaagctcaagtgcatcagcttgtccagccgccacgtcttctgctgctggtgcttcatttgataaaggctctttttcttctgcacctgcgtgcggagcgatcagccagaagaaaagcatcagtcccataacagctgtcacccgtttcattgtcatcacctcttttcaattaagtcatggacgggatcatacctaagatcgtctcaatgatgactgttaaaataggaactgccatgaccaagatgagaattttgccgccaagctctatttttgatgcaatggcgccttgtccagcatcttttgtcagctgggcgccgaattccgcaatataggcaatgccaataatttttaaaatggtttcaacatacttcatattgacaccggcacttgccgcaattttttctatcatcgagataatggcatagatttgatctattaaataaagaaagatcacacaccctgtaaatacaactagcaaaaaagcgaaggttggcttttgttctttgacgattaatgctaaaaaagtagcgattaaaccaagtccaacaatttgtatgatttcgatttgtaagccctcccctatccttgaaatagaaatacggctttaatctttttaaacaaatcatctacaatggttgctaccataaacaaaatgtagataaacccaagcagcgtgacccactgagcgtactcctttttccccatttgatctaaaatcgtatggaggaatgccacaacgatgcctactcccgcaatttgaaaaatgacgtttacatcaacgcccatgctctcgactcccttcctctcacatcaataaaagaatcagtagtaatccgcttaaaaatccgaggcttctgaccattttttcatttttggcttgggcgatctcagcttccttctcctccgattccaaatgacctaaagcaagcttgatatatttttgctgagacgtgacatcatgctggccaagtgtttctccaaagtgcttcagtgcctcatattcgcctttttttaagacggtttttttccaaacatcctcaagactctcattccatgcatgccgtgcagaaaaagttccacctttcagcttttctgcaaattgttcaaataaccgattcacaggagtgcctacttgtgacgcaatttgctctgctgcacgcgctagaggtgtttgaccatacataatttcagcttcaagagactggagcgcaaaccggagctgtcgaatttgtttcggccggtcgctatatcgtttggcaaactcgaaccctccccaagtcgtagccgcgacaatcaagatagcgccaatgagctttaacatacgtccactccccgcctccatttcatctcttgtccgccttggtcatatattcgtccgatcgtgccgggaccgtccttgcgatttaattcaatataacgctcaaacacacgaagctcccatagcggtttcaatgatggacgtttatatacatcttcaagtgaatagccatgaacggaaacgataatggtgacccccgcatgaatcgcttctaaaagtgcctgcacatcctcgcgtttgccgatttcatcgacaatcatgatctctggactcatagaccgaatcatcatcatcaagccctcagcctttggacacgcatcgagcacatccacccggtgtccaaactggtgctgcggcacccctcttatacacccagcgatttctgatcgctcatctataatgcctgtttttttaggaggaattgcttttgtgcccgtactagccagtcttgctatatcccgcaataatgtcgttttccctgtttgcggtggaccgatgatcagtgtattgcaccagtgctcatcatataaataaggaagaaagggaagcgcaatcccgactttttcttttgcgatgcggatattaaatgaagagatatctcttaatcctttgacaatgccgttttcaacgatcacctttcctgcaagtcccacccggtgcccgcctgaaatggtgatgtagccttgctttagctcctcttcaagtgtgtacatgctgtaattgctcagcctgcctaatagctgagacgcatcttctcctgttgtgtgataagaaagaaagcgcggttttcctctttgcattaattcaataggacgatccgtgcgaatgcggatttcttctatttgatcccattctgcttcttttagcagtctaagttcttgtccaatcgagtgcgggagaatatccaacaagctccgcaacgaattcccctcctttttttcttctctaaaatgtatgatcggagccgttaattatgccaagccgttttacttataaatcccaacaagaataaatacgacaccaatgaaaataaagacgagcttggcataggataactgccctgcgatttgataaattccaatcgtcatcgtgataataaaaatgagcggcccaatgatcgccaatatactattaatgacaaccgcttttcggacatcatttgtgactaaaatgaggatggcggctgtcatttcaatcgctgctgataaaaacctcatgcctgccatcgcagcgactgatggatggatgcccgggagaaattgtttcatactagaacctccagctttttttacactatatgcttgtctagctggaagtagtcttgtttttcggaaaggaaaagagatgaatgagagaattgagagaaggcgtaccttttgggggagtcttacatgttttacaataaaaaaagactgtaaacacgaggtttacagtcttttttcgttcattacgctcttgacacgtatgaaccgtctgatgtattaatgactagtttatctccttggttcacaaagaaaggaacgttgacgattaaaccagtttctgtttttgcaggttttgatccgcctgatgtcgtgtcacctttaataccaggctctgtttctactacttctagttctaccgtgtttggaagttctactccaagtgtttcagcaccatacatcacaatgtgaaccgacatattttctagcaaatatttcagctcatctttaatttgtgtttcacttagttcaagctgctcataagaacttgtatccatgaagacatgttggtcgccatttgcatataaatattgcattgtttttgtttcgatttgagctttcgctactttttcgcctgcacggaatgttttttcttgaatagcaccagtacgcaggttacgcagtttcgaacgaacaaacgctgcgcctttccctggctttacgtgttggaaatccactacacgccaaataccgccgtccacttcaattgtcaggcctgtacgaaaatcgtttactgaaatcattttgtcatcctcctacatttcaccatcataatatgataagttctttcggtgagtgggtcaatcgtttattgccgtcagctgtcaggacaatatcatcctcaattctcacgccgccgacatccggcaagtaaattcccggttcaactgtcacgaccattccctcttctaaaacgacctctgatcgtgaggaaaggcctggcgcttcatgtacttccatccctagcccatggccagttgaatgcccgaagtattgaccatagccatacttttcaatgatgtcacgtgtgatgcgatcagcttcttttcctgttaagcctggcttgattctatccacaccagcgttttctgcttctaatacgatatgataaatttcctttaacttatcgctcggtgtgccaacagcaatcgttcttgtcatatcagaacaataccctttatagtaagcaccgaaatcgagtgtaactaaatcaccagattcaattaccttttcactcgctcttccatgcggcaggcttgaacgaacacctgaggcgacaatcatatcgaatgaagatccttcagcgccttcttttctcatgaaaaattcaagctcgttcatgacagcaatttccgtcaagcccggcttgatgtaagtgagaatatgatcaaaggcgtgatctgcaatcttcgcagcttcctctaatatcttaatctcttcactagacttaatcaagcgcaacttttcaactgattctgagaccggaacaagctcaatatcacctgttttctctgcatactgctggtacgtggcaaatgtcatatggttttgttcaaatccaaggcgtttgatcccaaattcctttgccgtttgagctgcggtttctgcgatatttcctttatgttcaataatgtcgaaaccttttacttggtcctttgcttgctctgtataacggaaatccgtgataaaagctgcccgatcctttgaaacaacggcgagaccggctgaaccagtaaagctggtcatatactgtaaattaaagctgctcgtaatgactagaccatcgatctctaattcagataaaagtgttcttaacttttcaagtttcatgatactgctcccccttcactcactaaataacgaatcgccaatttatacccttctaaaccaagaccaacgatttgcccttggcatactggagcaagtacagaatgatggcggaattcctctctcttatgaacgtttgagatatgtacttcaacgacggataaagaaatacttgcaatggcatctctcagggcatagctgtaatgtgtaaaagcccccgggttaaatacgactccatcgtactgatcttctgcctcgtggagcgcatcaatcaaatctccttcgtgatttgattgaaagaacgttaactggatattggctctttctgcaaactggaacaaatctgtctctaaatctgtcagcgtcttacttccgtaaacagccggctctcttttgccaagcctatttaaattcggcccattcagcacaagaaaatgaggcatacaaccactccttcaccctaattcaatctatatcgagatctgtttctttttccttagaaacctttcgtttccaaaaatattttatcatatgaataggtgatttacactttattctgtctttttcccgagtgccctcgcaagcttttgactcgttaattcattatattcaaacgaaatactgtacccgacaaacatgccgtataaaatatataggcaaaatgtcgtgacgatggtgctttgctgcaaatcttgtacttgctttacatctgggaaaatcgggttaaatacgtaaaaaacgatcaaccataaaagcgcgccatatatcagccccatccaatagcctttgatccgtttcaaaagcccataataaataaaggctgctccgatcgataaaacccctaaaagcacaatactgataaaagtaccaagtccgccctttttccactctccgagtacaaaaggctgaaggagcatattgggactcacctctgagaaatgaaacatatgggtcagaaacccgataaagccccaaaaaacaccgccaacaaagcctgtcgcagctgctcttgccaatagcgatgacgtttgtacagactgattgttctcttcttggtttttcttttcatcacgtttcatttgtgaacacctccagcaagtagtatgtccaaaatgtcataaaaaaaaggatttccatacgtgagtgtaaaatttttataacagggtatactggctaaaaagaggtagatagaattctagtagataatcgacctgtgcgctagtgatttccctacatttcctgtacaataaaggtataaggaaatgcatgtaaattacaggaaacaggcaggttgatgaaatatgtccaatcaaacaaaacctccagcatatggagggcaggcagttgtcgaaggtgtcatgttcggaggtaaaaagaactatgtgacagcgattcggcgtaaggatcagtccattgagtttttaaagcttccccggaccttcaataaacgaaccgcctttctcaagaaaatcccctttgtcaggggtgttgttgcacttgttgaagcaagcgcaaatggcagtaagcacttgaacttctccagcgagcgctatgacttagatccttcagaagatcatactcttgaaaaagaacaacaaagctcaaaattatctatgattttcggcattgctgtgatcggagttctctctctcctctttagtaaatttgtctttaccctagtacctgtctttttagctgaacttgtgcggcccgtcttttcagggaatttcgcacaaatcgcagttgaaacattctttaaactggtcctgttattaggctatatttactttatttccatgacccctttaattaaaagggtatttcaatatcatggcgcagaacataaagtcataaactgctatgaacagaatcttgacatcacagtggaaaatgtccaaaagcaatcacgtcttcattatcgatgcggtagcagctttattttattcactgtcattgtcggaatgttcgtctatttactcgtaccgacagatcctttatgggtgagaattctgaatcgcttggcgctcattccagttgttctcggcatttcatttgaagtgcttcagcttacgaataaactccgaaaagtgcctgtgctgaaagtgcttggctatcctggcctttggctgcaattgctgacaacaaaagaaccttctgacgatcaagtcgaggtagccattgcaagttttaatgaacttcttcgtttagaggaagcgtctctgaaacaagcgtcagattctgctcatcaagtgatctaacttataaatccggtaaattccttcggaggtggacagttatgaatcgccgagtacatcctgcttttaccattattttcgctttaggtgttttgggatttgtgtatttactcacaacgaatccaggcagactttttacaatgctgctatcagttgtgatcattggagcggttatgtttttcctatttagatggctgatgaatcgaagaactggaacagagggcaatctttatcgtaaagcagtcaaacaatcaaaacgtcgctaccagcagcctaaaccaaaaacgaaaagccagatgaaaaatcgggtcactcatttgcgaagcgtgccgactgaccacaagtctaagcccgtccttctcaaaaagaaaagccaaacacagttaactgtgattgaaggcaagaaaaacaaaaagaagaatcgcgctttgttttaaaatgtccagctttttaaaaattgctcggccttctgtctgcctagatcgacgagcgcctttttcttttctgtcatcagctgaaaatcagtggcaatgacgtgttctacaggaataaaaatcacatgacgttcgtgttttgtggcaatgtgtctttcgtcatgagcaccacgcatcgtttcaaaaagagcgccaaacagttcaaacgcattgcggatggagtgttgagggcgttctttttcgtttggggttagtgtgacaccgacgaacggtctttttttctcttcggcaaacaaccaaattggaaaattactaagcacgcctccatccacaatggtacaaatgccttttgatgactttagtttgacaggctcgaaaaaatacggcagactgcagctcatccggattgcccttgcaacagaaaaacgctctggatttaagccgtatgaaggaaggtcgtctggcagcacgagaatttttccatttgttaaatcagaggcaacaattttcagcgaatcttttttgagatccccaaatacggtgaccccctttcgtttcaacacatctgtcagccatttttccagccggtcgcctttgtaaagaccaagacgccaataaatagacacccatctaagcattttaaacgggatgaattgacatctcctatcaagcaactgatgttcatccatttcatctaaaagcccccgaatctcctgacttgtaaagcctgccgcgatgagtgaagcaatgatcgctccagcacttgtaccagcaaggcggacaaattgatatcctctcgcttcaagcgcttcataggcacccgcaagtgctgcccctttaatgcctccacctgagaacacaccatctatcttcatcgaggagccccctttgatatcacgctattaatagtgtaagagcatatgctttcaattagaactttaatcaaaaaggacacccatgctgagggtgtcctttttcttaagattcttgatttgtttgttcgttcttcttttgaatcgctttcagctgaacagatcgctcgtcgttttcttcaaagaattgaacgagatcgccgatacggtcaatgctgttccagctgagatgatgttcaatgccttctacatcatcataaattttctcttcatctacaccaatgattcttaaaaattgctctagcagttcatgtctgtatacgagacgttttccaatttttttgcctttcggggttaaaattagaccacgatacttctcataaatgaggtattcatctttatctagcttctgaaccatttttgttacagaggagggatggacagcgagtgcttctgcaatatcagagactctggcatatcctttttcttctatcagcatatatatttgttcaatgtaatcttccatactaggtgtagtcataaaacccctccataatgcacctttacttaataatcataacaattctacaccatcgcccattaaaaaacaaggagtgtccactgtctttaacgcttgtaattccactcgtctgatgcatatttcgttttggcaaggtggtggacaaatgctaactcttcatctgtcagctcataaggcacaagctcaatatttaatcctttttcaaatcctcgtttaaacgccacacgcgcatcatctattgtacaggttcggtctgagatttcattgatggcgaccgctttgtttttaaagcttctctgcatccgctctctcacccggtcgtttggataaagaaataaatcgaacaatttgtcctcatcaaggtcaattaagatggagccgtgctggaggatcactcctttttgtctcgtttgagcactgcctgctacctttctgccttctacgacaagctcgtaccaggaaggggcatcaaagcatacagacgatcttggattttttaagctttctttttctttatctgttcgaggaatggcaaaatacgcatcgagtcccagttctttaaagccctctaaaatgccttctgaaatgacgcggtatgcctctgtcaccgtcgccggcatttctgggtgttcctctgacacaatcacgctgtaggtcagctcctgatcatgaagaaccccccgccctccagttggtctgcggacaaacccaaggccataacgctcgactgcttccatgttgatttctttttcaacatgctgaaaatacccaacagacaatgtcgccggattccatccataaaaacggatcacaggcgggatgagcttctcactatgccaataaagcaaggcttcatccattgccatgttaaaggcagggtcttgatttcctgtatcaatgaaacaccatttctctttttgcatataaaaatcccttctcttttacgtagtcaaagttagatgatggtcacagccaccgatattctctcttcatcagtctatcaaatagggaacgaattgaaaataattctaaccatttatgatgacaagtttcttttgctttactataatagtatttgtctaaaacgtaccatcagacaggccactgtgctgatgctcaagaaggagtcgagttgtattgtcaatgttcaactatatcgtcctctcactttgtggacttttcgttctttattctgtcggcagctacatttatcagcagcgtattatgaaaacgctgacggaagcagaatttattaaaggttaccgcaaagctcaactcattgatgtgagagagccaaatgagtttgatggcggacatattttaggggcaagaaacatccccctttcccagctaaaacagcgcaaaaatgaaattcgtcctgacaagcctgtttatctctattgccaaaacaatttgagaagcggaaaagcagcgcaaactttacgtaaaaacggttgtcgtgagatttataatttaaaaggcggctttaaaaaatggggcggccgcatcaaaacaaagaactaacaaaaaagactctgggagcatgatccccctgagtcttttttctttatctttcaaaaacgagaactggatttcgcgcggcctttgtttcgtccattcgtttgacgaccgttgtatgcggcgcttcctgtaccacttctggattttcttctgcttctttggcaatctgaatcattgcttcgataaaggcatcaagagtttcttttgattctgtttcagttggttcaatcatgatacattcctctacattgagcgggaagtagatcgttggcggatgatagccaaaatcaagtaatcgtttggcaatatccagtgtacgcacacctaattttttctgacgtttacctgaaaggacaaattcatgcttacagtgacggtcaaatggcaaatcgaaatgagtacttaaacggcgcatcatatagttcgcatttaacacagcattatcagttacagcctttaagccgtctggacccatagagcgaatatacgcatacgctctgacattaatgccgaagttgccatagaacggcttcacgcggccaattgattctggtcgatcatcatcgaagtaaaagcggccttctttcttcacaagcaccggctttggcaagtacggaatcaaatcctttttgacgcctacaggacctgaaccagggcctccgcctccatgtggacctgtaaaggttttatgaagatttaagtgaacaacgtcaaagcccatatcccccggtcttgctctgctcaaaacggcattcaagttggctccgtcataataaagcttgccgccagctccgtgaacgatttcagccatttctaaaatattttcttcgaataggccaagtgtatttggattcgtcagcattaaagccgcagtttcttcattgacaacacggcgcaggtcctctaaatcaacaagtccattctcatcagatgcgacggtaatggtttcaaatccggccactgtcgcagatgcagggttcgtcccatgagcagaatccggtacaatgacttttgttcgcttatggtctcctcttgcttcatggtacgcacggatcatcatgagtcctgtccattccccgtgtgctcctgccgcaggctgtaatgtcacagcgtccatccccgtaatttcttcaagatgatcacctaggtcatacaataattctaatgctccctgcacagtgtccgcctcctgtagtggatggacttgcgcgaagcctgcaaagcgtgcaaccttttcattaatctttggattatatttcatcgtacaagagccaagaggataaaatccggaatcgaccccgtgattacgtcttgataatgctgtataatgacgcataatatcaagttcagatacttcaggaagctccgcatcctcatgacggatatacgcctcatcaaataaggacgggatctcctgttcaggtacatctaaatcaggcaggctataaccaattcttccttctttggataattcaaaaataagcggctgatcttgtttattcatggcgatcccccaattccttaatgaacgtatcaatttcttctttcgttcttagctctgtcacggcgacgagcatgtgatgttgaagcgctgggtagtctctccctaagtcatagccgccgatgattcctttttcaagcaatcgtttattggcttcttttacaggttcttgtaatttgatgacaaattcattgaaatgggccccttctacatcagcaagcagtccatatgcttctgcctgcgtcttcgcatagtgagctttttgcacgttttgataggcgatgtctttgatgcctgtttttccgagcgctgtcatggcaacggaagcggctaatgcatttaatgcctgattcgaacaaatattagacgtcgctttatctctccgaatatgctgctcacgcgcttgaagggttagtacaaacccacgaacaccattttcgtcttctgtctgtccgactaaacggcctggcacttttcgcatcaactttttcgtcacagcaaaatatccgcaatgtggcccgccaaacgctgctggaatgccaaacggctgtgcatcaccaacgacaatatctgctccaagttttcctggcggtgtcagtaacccgagtgcaagtggattactagaaacaacgaacagactttttccattatgcgcaataggttcgatgtcttttaacggttcgacgacaccaaaaaagtttggatattgcacaagaactgctgctgtctcgtcgcagacagccttttctaatgctgctaggtccgtctgtccttttttcgcaggcacttcaacaacttcgatgtgctgtcctttggcgtatgtttttagcacggctcttgattcagggtgaaccgtttcagaaacaaccacttttttcttttttgtatgtccagcagctagcatcgccgcttcagctaatgccgtcccgccgtcatacatcgaggagttagcaagatccatacccgtcagctcagcaatcattgtttgaaattcaaaaatggcttgtagttcaccttgcgaaatctccggctgataaggtgtgtatgctgtataaaattcagaacgtgagatgacatgatccacaatgacaggctgataatgatcatagactccggcaccaagaaacgatgcataggaaatcgtatctttgttctttgcagctaatcgggataattcccttacaagctctgtttcagatgcggctgctttaatgttgtatgctcctttaaatctcactttttctgggatatctgaaaaaagctcatcgatcgactgaacgccgatgacatccagcatttctttttgatcttgctcggtttgcggcaaatacctgtgcttcatcctctattccccctcgttatttggctcttttataaaatggtgttgcgacgatttttgcttttagacgttttttgcgaacttgtacttctatctctgttccaagctgcgcctgagaagattcgattaaagcaagcccgacatttttctttaatgttggggattgtgtgcctgtggtgacaactccaatctgcttttctcctgagaagactggatagtctgtgcgcggaatccctttatctatcatttcaatgccgacaagctttcgcttcggcccttcttctttttgcttcttgagcgcttctttgccaataaaattggcttctttatctgttttgaccgcaaagccaatcccgccttctaatggagagatctcctttgtcagctcctggccataaagcggaagtcttgcttcaaatctcaaggtgtcacgcgcaccgagcccgcacggtattaacccttttggctcgcctactttcaataaaaccgaccaaatgtggaccgcatcttctgacttgcagtagatttcaaagccgtcttcccctgtgtagcccgttcttgaaacaagcacctctttttgagcaacctcagcttttgataaaaatgtaaatggcttgagcgatgtcacttcttcacccgctacagttttcatgatgtcagcggcaagaggtccttgaagggctagcaaggcgatttgatcagagacattttggatcaatacgtcgttcgcctcttgatgctgaagcagccattccacatctttttcgatattcgatgcattaatgacaagcaaataatcgttcttttctttttgatagacgagcagatcatccactgtcccgccatcttcatagcacatggctgtatatagtgccttgccgtttgtcagcttcgacacatcattggttaataacctttgtaaaaaaggaagggcgtcttgacctttgatttccacctcacccatgtgagacacatcaaaaagccctgcctttgttcgaacagcttcgtgctcttctttaatggaagaaaattggacaggtaattcccagcccccgaagtcaatagtttttgcgccaaacgtttcatacgcatgaaaaagcggtgttcgtttcaacatcaatcgtttcccccttttttctttcagtgcagatcacaagctgaattttcagaaaaaaatcacagcaaaaaaggacagagcgctcccttttatcaaaaagaagtctctgtccttgcacctgaaagtttacagcacaacatcattgtgcgttttcccctttggtggtttgctaaaaaacgatgagcaaacactctccagagttgcgtccggtaagagtacttttgcctgagagattcactgaaacaattcagcttgctccttcggcgcctgccagtgctaaataaccgccaagtctctcctcataccatcatccgctcatattcttcacatttattggacatactatcaaaatgggtgacttattttctagatcacttaccaacatcctaccattagaaacggatgaagagcaacagaaaaatcattaacattttttaaacaaccactcattatcgttcgcttttattcaaatatctagtcttttcaagacctcttaaaaaatgaagcgtttaaatacagaacaattttatccttaacctactagaaaggcaggcgatcacattgaagattcaaacggtttttgatcaggaatgggcaagtgaatttcagcagcggctttcagcagacggaccatgggcgaactgggaaatgtaccgtttagcgacgcaggtccaaaaagtcacagccattgattcatttgaaggactgcaagctcctgcccatctgcctgcattcacccctttaaaacatcagcttgaagttgccagaagagtcgtagaagagatgaacggaaaagccattttagcagatgaagtgggacttggaaaaaccgtagaagcaggacttattatcaaagaatacatgattcgtggacttgccaaaaaaattctcatactcgttcccgcctctcttgtatctcaatgggtacaggagctgcgcacgaaattttatattgatgctgtcgaacaaaaaaagagctacgtgtgggagcagtgtgacgtcgtggtttcctccattgatacagctaaaaggcagccgcatcgagataccattttatccattgcctacgatatggtcattatcgatgaagcacacaaactgaaaaacaataaaacgaaaaactatgaatttgtgagaaatctaaataagaaattctgcttgctgctgacagcgacgcctatccaaaatcgtatcggagaaatatttaatctcgtttctcttctgaagccaggtcacctagggaatgaacatcagtttaaagatgtctttgccaaaaaggatttacagctagaagaccatgaccgtttaaaacagcttgtgaataaagtgatgattcgtaaccgaagacaagatacgggcatcgagtggacaaaacggcatgtcaaaacgatttccattgatttctctccgacagaacaagcattatatgatgaaatctgcaagctgaaagagaacccttcttatacgaaacacatgttttccatcatgaccttggaacgagaatgctgttcaagccgtgaggcggtctatatgacaattaaaaaaatgcaggaagatgaaaaacatatccttggttcctctgctatagcgcaaattatggagaaaatcaaccaagtgcagcaaaacacaaaggcgcttgaagtcgtcaagcttattcagcagttaaatgaaaaggtcattattttcaccgaataccgcgcgacacaaatttatttacaatggtttcttcagcaaaatggcatcagctccgttccttttcggggcggctttaagcggggcaaaaaggattggatgaaagatttatttagagaacgggcgcaagtgttaattgctacagaagcaggcggtgaaggaatcaaccttcagttttgtaatcagatcatcaactacgatcttccgtggaatccgatgcgtctagaacagcggattggacgtatccaccgccttggacaagagcgggatgtccacatttacaatatggcaactaacggtaccgtcgaggaacacatcttaaagcttttatatgaaaaaattcagttgtttgaaaacgtcattggcgatctagatgatatcttaacgcgaatcgatatcaaagatgccgaaacagaactgcatcagattctttttcatcatgaatcagatggagacatgaaaaagaaattaacccagtttgcttcctatttaacagaagcaaaaacaccgcttttagaaaaaagacagcaaggctcataaaggagagttgatcaatgaagcagcgtgacatacatacctttcttctccgtttctttcaggcaaatcaatgcgacatactggaagaaagcgcaggacatatgaccgtacaactgaccatcgatatggataaattgataatgaaccgccctttttattggcactggcttgaaaaaactggtggtgttccggagccgcggcaattgaccctcatcaccgatcaaaaaaaagtggatgacactattgaaggtgaatttatccacttcggctcccctcgtttatttcagatttttgaagccgtcaaacagcagggccgatttatccgtctctatgaacgagtcactccactcatgaccaaccagatcgcactcgagccttggcttggtctcaatgtgaaaatttcttatctcgcagatcgaaagaaggataagcttttatcactaggacttcatctcatacgaggagaagtcgttgaacaatttcaagaaaagctagaaacccgtgagctgtcatctcaaattcccgattactgctttacgatgagtacaatgatcaagccagaaagcggaatcagacggctctacagtttaatggagcattacgcccatgaggaaccagatgattgggcggtaagagctgttcaaaaatggaaagaagacactgaacttttaaaccaattttatgaagggacttcagacacgtctgtagaatatgaaatagaaagacaagcactcaaaactttatacgaaccaaaaatcagtctaacgattgaaaatggcggacttttttacttacagcaaaaaagaggaggttgatccataggtcccctccctttcatgtgacgtacaattttcgatcagccaaaagcaacgtttgtctgtttgtattgggcggaaaaatgacgcaagcaaactacgaggtcttaccacctgtgtctttccatttcatgcgttaagtgcctgaaatacatgattcagtattttaggagggtatttgtatggaaaagaaaacgaacatattagacagtgaatgggttcaattattacttgaagctcgtaaagcagggctaacagtggaagaagtccgtcaattcctcaaatcaagtgaaaagtcctctgagtctcaccctctggtaagaagtcattctatcaaacctttctgaatgtgctataatatcgaaaggaaggtgatgacattgattggccagcgtattaaacaataccgcaatgaaaaaggctactcactatcagaactggccgaaaaggctggggtagcgaagtcttatttaagctcaatagaaagaaacttgcaaacaaacccctccattcaatttcttgaaaaagtctccgctgttctggacgtctcggttcatacactgttacacgaaaaagatgaaaccgaatacgatggtcaattagatagtgaatgggaaaaactagttcgagatgcaatgacatcaggggtttcgaaaaagcaatttcgtgaatttttagattatcaaatctggagaaaaaagcaagaagaggagtaaagcgcacattttagcgcatactcctccaattgctatgcagaacttgatatcagtctaaagactggctttattttttatcttcgctgtgtgctttttcgttttctttcacgtagcctttttcatccgtatgctttttgggattgatcgttaaaccattccactgagtcgcttcgaaggaaagatcaatttgaatcgcatcgccttggtatttattttggatatagtgaccagctttatccttcgtctggtcattgacaaattcaatgatcatttccattttatcgtaatcaaacgggttctttggtatgccgtcatactctggagccactgttccatcaacagttgctacattaatcttcccgctttcatgtaaaaacttctcatcgacggcatgacgaagcttttcaaatgcggtctgatcctgttttgccgttagttgatgcaagtcaagcaggtttgcagcgtctaagataatatttttcggataaccatttccaccttcagctccgaccgtcagaacacttacctgaaactggctaagaaattcttcagctgtattcttaccgccattttttgcggaagctccgtcttgaaactggctgtaatcaagactcatcagcacttgattgatcgcaagcgatcctttattttcaaaattaaattcttttttgatccgatcaccaggttttaagtttgaaaggttgatggcgccggagttctcttttgcagataaatccagctctcctgtcgagtagaccgcgtttgccgtttcaacatcgttaaacgccgcccatgtccccccaccgattaatgccaggcctaaagcccctgataatacacctaaacgaattgatcttttctttaccatgaataaaccccctaataaattgttttattgaaacctaattaggttacaaacgaaaatttaagcttgttcctctgacatatgtaaatcagatgtgcgtcttcggtgttttgcagcgcccacaaaatgaagagttgaataaacgagcagcatcacacctggtataatgagcagcaacgcggttccagccgaagtcccagcatacgaaagaagctttcctgcataaggaatgttcacacccgtatactgcgcagctacctgatccgcttttactagcgtgccgtcccgatacatattgttgtcacctttcgtctcaaaggctttatttgctccctttcctttcaccccaacaattcggtgggtcacataagactggtcctgttttgtttgaaacgtgataatatctccttttttaagcgactccggtgaagtcacttcttttacgacaatgagtgagccagttggaaattctggttccattgatccagataatacttgcttgaattgaaaaccgaaaatttgaggatctcctcctgtagttcttgatgacaatacgacaataatgcatgcaatcatcaccgtgaataccaccacataaagaatacttccagacatcttcatccattttttcatgacctcttctccccttcgcctatcattaaaaaagacagctctatttaagataccttttcttgacactttacgagctgcatatgtttagaccatataaatgctttttcagacccaccaaaacctataggataataaattttaaacgcataaattccattcgtttttgctttatctgtcgtgacagtcactgtttcttgtgaaagaagggattttatagaacctttttcaagaatatgaccatcttgtaacggcttctgctcacttttcactttatgtaattcccatttccattcagagtgtgcaatagattgtccactattttttaatgtcatgctcaagctttgaggcgcacagactgttcctttgatcattgtttgatcgatgagttccaaatgacttctatcccatttggcaggctgacaatgctgatccgtctgttcaaaattttcgcatgttttcatgacaaagtttgagtgctcaacatcgttaaaagaagcgttcgttgttgagatcaatagagacgtgaaaatcaaacaaatggcacaaaaaagtacaaagagcgactgtttcattcattctccaactccttgaacgattgttctttaataagaacgattacatacagtataaggaaatacctataaaacccaaaacgtcaaattagtccattttgttcttaaacaagaatgattacgagaaaattcttccattttctcattctttcgccgtattcaatatttttttgtgtgacatttgtacttcttaaaaatttacataaaagtgcagcatttggtcaaaataatagcaggtgaggtgatgtgaagtgaaatatggaaagatgataatcatgctctgtttactgttgattcctatgatacaagacaccaaccctgcggatgcgagaggtttcactgccgccgcagatcaatgggaaacacgggcagtcaaagaagcaaagaagcgatatcctctaacgcaagtcttattcaaacaaaaagtatgggaccgtcatcgcgagaaggaatctgtgaaacagtatcatattacattaaaagaccacaccaaagaatttggggtatatgtcactatttcttataatccctactcaaacaaggtcaataaagtgattgttgtggaagaatacagctaaagaggcataaaaaaaccgcctgctggcggctttttacttttgtcgatgtcgcttacgtttttttagcatcattgaaaacccaaacggcagaaccccaaataaacgctgtgaaaatggcggtttcgtttccattttctcttgtttatgttccttccgttcgtcacgtggtgtattcatatatttaatgatttcctgtgtcatatattttacatagtcatttgttttcaagcacattcacctcttctttcttcaagtgttaccaggaagaggatcattttatacactggctattcactgtttgcccatttcatgatttcacgggtcttccaatttagcacgagttcccgctcatctgataaaccatcctttgttttcacactgactaacatgtggatatgctttttcttttgatcgcatgtcacctgctttaatgtcactcgtccttcttcagtgtcaataggggtatgctgcttttcacacaaccgatgtaatgtactggcagcttcattcgcacccaccctgaaaagctgctgttttttataaaatgaaatcgtcagctctgcacttctcagctctctttgaaaccccatcgtcatcgcccctagaatcaagagaaaaaatagaatcgcagccagtacttgcggatagataaatcctccttcccttttcacgatgtaggtaccacccctttatatatgaaaaaaacggcttcatacaccttaccagattcatctgtgactttaaggatagctttgtgctgatttgttcttacgcgaaattctttcaccttttgcaataaagggagatggcctgcttgatccattctctttcgaagcatctcttgatatggctcaatcgttacgactcgcccttgatcagacacatactctaacgctttccctccttgcgccgatcgaatagccgttgctcggcttaattcctcatctaattgcagcacagtctgcctccactccatttgtgaaaatcggttgacctcttcaaaaggacgagctttctcagctgtagaaaagatcagtacacagccaattgaaaggaacaaaaagagctgcaattgccacaaagcctggacaagggtaaaacctcgttcaccgttcagcaacatggtgaaagcatatggtctgctttttatgtatcgtgtatgatacacatcccttctctttactccaattgaatacatatgtgatgtcgcctcgcttctttttgacagaagtttttgtaccatctatgaacaattcattcatctgttcatgcaaaatttggtaagcttcaagtttggctcttatttcatttttccctatcatgattttttcataagctggcatgagcacaagagctgcaaataggaagatatgacaagcaaacagcgtttcaatcgtactaaaccctctattgcttttgaacatggattcgcccgcttcctaaatagatcgtgagcttatacgtttgactgccaaattgaataatgagagacccgccgctgctcggatgtccgtttacattaaaatagataccttgtggaaatgtagaagccttaatgcttcccttttgctgcagaaaagaagcaatgatttcgccatccttttgatcgattacctgatacgatacatgtggtggatggaattcaacatacacacgtgtttttttgacaaatgcagtataagcagccaattgaaaatcttgtttcatgatgttcacttgtcttttggcttcagcgtcttctattacatttgggattttcactcctatgatcgacaatagtatcgatagaaccagtaagatcattagctgttctatgagggtaaaacccttttcatgaaaaactaatttattcatgcttcacatggccgttttgaatgacaatcgcttttccattaggacacgttaatccctttttgacataaccttctttttctaattcagctaaagatggtgtcttgccatcgtgctctaattcatatgccatcacctgtgtgctcaccattgatttaagcccttcacagccctttgcttgaatcgtttggtggtgacgagtgatattcggaatggtaatcagtaaaagaattgaaatcacaagcatgacaattaacatttctaacagagtaaatcctttatcattcatgtttttgtcctccttcttacacttgctccatcagttgatacattggtaaaagaatagataaatacacaatgagtattagaattgccgtcagaccatagataaccggctgcagccacgacatccatttttcaattttcagctctgcattctctaatagaaattggctgtacgtgtacatttctcttgcaagcatcccgctcgcttcaccatgttcgatgacggcggcaaaatgtttttcaaaaaaaggagacaggctcacttgatatgccatgctctctccttttcttaactcttcaatcatctgttctgatatttcttgaagaaagggtaagtagctttgctgcttaaaagctagcaagctctcgtacatcgataacccagcctgaagcagtccgcttaactgtagagagaaaaggtacgtatgcatcagccgcattcctttatataaaaaaggaaacctgcttatgaccctcagcttctcaagggtagattttttcctaaaaaagaaggcatagtatccagtcagacaaatacacacacagccgatgaggaggagagatacatgaagcaattgaaagattccaaacataccttgaatcagccatgacattcgggtatccatcgaggagtacaagagagaaaattgaggaatgatcatttgctgaacaagtatgagcacgatcaaaaccgtaaagatgaggaaaattgggtaacgtaatatgcgtttaaacgtgtctacctgtttaatttttttctctaaaaaccgtgcgctttgtacaagtgctgttgctagactgccatgcttttcggaaaaacttaaaatggcgatgacttcccgctgaaaatgaagtctttctagcaccacatacaaaggctccccttcaagcagccactgaatgcccggtgctaattgttgctgctgtttattcgacaactgaatattcatcatcgttaatgcctcaaccagtgtatattcagcctgaatcaattgagcaagttttgatagacattccgcttgatcctttttagaccacgctttataggcttgcttcttcataaacccagcgatgataggtgtttttcgataaatagcctagtgccactcctttacgaattaatctttgcagtgtttcatatgacgagtgagcatattctcctttagcctccttgatacactcaccgagctcctttccgaacagcagttcaaatacatttgttcgtctgaccggacgatttaatttacagtaaagctggcatgtttctccgcaaaaaggacaggtgagctcgattaatcgctgcgcagcaatcgcaaccatcgtttgttcgagttcattcatcgtgacaccaaattcaagcatacgataaagggctccttttgcatttttcgcatgtagtgtactcatcactaaatggcctgtcagtgctgctctaattgccgttcgggccgtttcagcatctcttatttctcctagcacaatcatatctggatcatgtcttaaaatagcgcgtaatcctgcggcatatgtgataccggctttttcatttacttgaacctgtaacacttcttcatttcttgtttccaccggatcttcaagtgtaattatatttcggttaaaattcttttttgcgaactggatcaatgaatagagggtcgttgttttgcctgaattggttggaccggtaaataaaatgagcccatgcgaatgattcaaaaacgacaataatcgagtagaggctttcggaaatagtgacagatgttttattttcggaacatgatcctgcggcaatattctaatcactaaactttcatcatttacagttggtaaggtagacattcgaataaacacctggcctcttctcagcatcacagctagcgacccattttgcggtctccgtttttctccgatatccatggacgataaaaatttaaaatgagcaatgagccgctcgccgctttttttatcaatggttcgctgctgaattaaatctgagtctactcggaaagatacagacgcttccttttcttttgggacaatatgcacatcagatgccctcatacggcatgcttcttctagcagctcttgtcccaaatattcaatcccatacaattggttcactcctttcagtgaccctattgtaaggtggtagaacattcctgacaaaagcgtatttcttcattttcatgactgaaaaggtgtgaacatgttcaatatgagatgtattccatctataaataatagaagcgcatataaaaaaattgatttttacaacaacgggttccgttcagaggggaaaataactaaataacattaaaaaaagagatgctattggcacctcttttttatactaatttacataggatcatcactattttattttgttcttccattgtggatgatccgttacaacgaatgagttaaatagtgaatcatacttatccccttcgagtgagaaaacagaaatttgaggttgagaaatcattgactcatataatgtgtctaccggatgggacaattcttcaattaaaagttcggtcataactttatctttaatatctactagcccaaggtaatcctcaactatttccgattctaaaaatggttgtgctttcatcatttctgtcatttgtccatttccagagaactttaataaatcacgccagtacggacaagccaacatgagtgaaataaaaccattaaaactttttccaacctttccagcctttccttctgaatcaatatagagaactgggcgcttttcaacttcaccagaacctattaatgaaaaaattccacccgacacgtcttgagcaataatcgcagcttgttcatccaccttaaaatgaaatttttctgtaactgaattaggctcaatcacttcaaagtcatagtattcaataagatgattaactatttctggtttgctcaaaattgttgcaaacaatttcggtgtttccaaatgtatgtcctcctcaacaggttacttattacggaagataaagaataacctttcatgtctgttcggaaatgacccaattcacattatctgagctttgattttccggctttatttagctccaattcatcatcttaaataaagactccttattttggttgatgaattaacaaaaattccagcaggtattttagcatacagattggacattgactcataatgattatgcatcataaaataggtatgttaaacgaactgtaaaagacaaatcctattaaatcagcatttatgggtaaaaaaagagaccaaacctgtatgcgaattggccatctaatgaatatgctaattatattgtttctccttgtcaacggacccggtacttttacaagtacaggttttttgttcatgttgcttcttgctgctgctcttcaaagatacgaaatcctcttttttctaacgcttttgcaaggctgtgttctgtatttacttttgagaaatcaatgccgagtttcactacagtttgagcgatctctgggcgaatgcctgatataatcgtctcaattcctagtagcttcgaactatcgaccactttaaacagctgataagcaaccatcgtatcaacgatcggtacgcccgatatatcaatgaataaatgcgttaaacgaagtcttgaagcctgttctagtacggattccagaatgattttggctcggtacgtatcgatttctccgatcagcggcaaaatcccgatttcctttgataccggaataacaggggcactcagttcttgaatcatctctctttgtgcattcagctgactgagtgtcacgcggtcatattcttctgataaacgctcaatcatatcatcaaatgtggcgtgaaagtgctgattccactgacacacatcttgcagggtcacttcaagctctgtttcttgggtgaatgtctcaattctcgaacagaaaatgtagcggaagatcttaaattgtccaatgatttcatataacggcacctcgtgcactgctcgatcacgagcaatatcaacagaccattttttcaaatggttttctgctttgtctgacagtgtcacaagtgttgctgcaatggtttgaataaacgctgtattctgttccttcagcttcttttccgtttcctctgaagcatgtttagaatataatgagccttcttctgttcttgtctttagccattcttcggtcatgacaggggcttcttttaggataaattcatataattgcttagatttttcattcttcatttacttcttccgctcctttttcacttaaaactcgtgacatacaacttttatgtataaatgaccgtagatggtgaacaatatcattacacgtttgatattgggctatagccaagtggtaaggcaatggactttgactccgtgatcgttggttcgaacccagctagcccagttcagcacaaaaacgaagacggctgaagcatgtttcagctgatcttcgtttttattaggaaactgattgatgaatcgctttcttttttgataatttcatgagttctccgggattatagcctactactaacttatttccatcaatgataatcggtcttcggagcagttttggtttttcaatgagaagttgaagaacctcgtttacttttaaatcattaatatttaaatttaaacttttaaaagcttggcttcgtgtggctaaaatttcatccattccttctgttgttaaggaaaggatcttttttaattcttctagggttggcgtttctctgaaaaggtgacgctctttaaaatcaatttgattcgcctttagccaatgttttgttttgcggcaagacgtgcagctcgggtatgaataaaaagtaatgtcactcattagtcttcctccttaggtcgttaaccttttctcttatggagtaagtaccctcatgtatttcggcataaacacattttgatcactttttcaaaaaaattttttctacctgcaaaataaatgttcacacgttgtcaaaaatgtaaatgtttacataacaagtggtgatcagctataatatgaatcaaaggggtttttttaaggggagggaaagaaatgaatcgcatgttccgcgtgcttggcttttggacgggtatttttgctgtcatgttctatttagggcatatgaaagatgcatcgttgctgttcttcggtcaaaccgttctttttgtatttttatcctacttgaatctatccgaaagaatgtatatttacattttcggagcgtacttgacgattttctttgccggatttacatattattcgattttcatcatggttcccggtaccggacattaattgaaaaaaagcatctctataaaagagatgctttttttcatacatttaaagagaaaaaccattgataaatggattttgttcctgctccgtgagtacagtcgtttctccgccatgtccacttaaaacaagagttgattctggtaatgacaacaatttgttatgaattgattgaagcagcacttcttgactgccccctactaaatctgttctcccgatgccgccttcaaatagcgtgtcaccagaaatcacaaatccttcttccgccgaatagtaagatacactgcctggtgaatgcccaggagtgtggaacatctctaatgtaaacgatccaatttgaagagttccttctgacgtgattaatttttcagcttctttgaccgtaattccattcccaatcaatcgagctgaaccgtttaattcagcgttcgtgagccattctttttcattctcatgtacatagagtggcactccccactctgcccgcacctcatctgcggcaccgatatgatcaaaatgagcatgtgttagtaagacagcaagcggtgtgagctgtttttcttttacataggaaatcagcttttgtgcttcaccgcctggatcaaagattaaacattctccgtgctcatttttccaaatatacgcattcgcttgtacatagcctagtggcattcttctccaattcattttcatcacctactttattcattcttttttattatgaaggctacacaataaaaattcaaacaatcgtcaacttgaatctactcgacaagctttatgaaaacggttaaaatgaaaagaaaggaaatcaaggggattgatgacaaagggggactttcacatgatgctcgtcattatttttggtctagtcacgattttagctgcactcgggatctatcgctcacttaaaaaagtgaacgtacttgccatcgcttttgctggcgcaacatttttggtttttggctggtttactgtcatgaccatcatctatagcggttatccaactgcacattaaaagcctgcatatagcaggcttttagattattgacaaagggctaaaatgatttttattttagccctttgtcttcttttcagcgtgacatgaaaacctttgcagtcctaggaaggacgagtaccgaagcggagcgaatttgacattcgtgagcatcggagcgcagacctgacaaagaatgcgagggtttttctacacgctgaaagcctgcatatagcaggcttttttcattgattcaagtgcttattcacgctttctattttacttgtaagcgttgtggtttgatcccgcctgtcatcaatgcggatattggtcgctacgcggtgcagtcccttttcaaaaggtgcttcatgaatgcgctgaatgacttcaaataaaacggataattcaccttcaattaacgtattcattggtgttaattgataattaattttcccttctttttgaaagccttctaaaattctttgtacatctgctacataagcactgacacttggtgtttcggtgcctattggaatgatcgtgacatctgctatggccatgtttagtgcccctttccattgaatcctcatgttttctcgtcctcattgtaacctattcgcattccatcatgccatgctcacgttgcatttaaagaaggtttgtctctttctatcgtcaaatccgccctctttaccttcccaatctttgtgaatagcagcaggcatatcccagacacagcttcaatgatgccgccagccgcaatgacatatccagacccaaatcgtgttgccatatagccgccaatgagtgcgcctaacggaatcatgaagaaggaaatcatattgataattgcatacacttgcggctgatcctctgcttttactgacaattgaatcattgtatgttcaggcacgttgactgcactgatggcggcacctaaagcaaaagctgatataaatacaagtggtaaaaatgcgttcatacctgtgatgaaaaacgagattccgtcaacgatcccggcacctataaacagcagcccataccggttcacttttacctttgtcaaaacaaatcccatcaagaatgcacctagtgccgttgtgactttaataaatgaatagatcactggtccactatgtaaatcctctgttaaataaataaccgacaatgcttcccatggtgcggcagcaaagttcgagcagacacaaaaaatcgccaatgggaacaaaatatgatgccttctcacaagtgaaaatccccgaatcaatcttttgccgtatgataacccttttttggctttatcgatgatgatttctgtttcatatgtaatgatgaatacgagtaaagcggacaagagataaagaggaataatcacaagcattgtatatcctacccccacaaatgcaatcatgacaccacaaaccgtaaccgtcacaagcctgactacatgacttgctgattgaatagttgcattcgctttttgtatgaggtcctcatggacaagctttggaataattgatacagacgccggttcgtaggagccaccagttgctgaatgaagcagcatacagccaataacaagtgctaatggcgtgaaaccataaaagtaactgaccacaatcacaaggattatcgctcctctagttaaatcagcaaaacacatccaaaatttcagttgatgcggcttcatcattggggtaatgagcgggccaacaatggcttgcggaacaaagctgaccgcaataaaaaaggctgttccaattgccccttttccgcctagtactaaaagccacaagatggtgttgaaagataaactatcagcggttattttgaacattttagaaataaataagtaagtgaaattccttttccacaggctttgagcactcaataatcgacatctccctaaaacatatccttttttttacatccatatctttcacaatagctcacaagagaggccttcgtcaatgaccctactattatttttattgacaataagaaattgcttcatgtcaaatgtaaaaagcacctgacaggtgctttttaacacttacatgcttcccataacaaccgctttgttttctcatagatggtgtcaaattgattcatggaaagaggattttttcctagaccaagctcgactgtatagccctcattgtgacattgataaataaaccaatcgcgatagcctgcatagctgtcaagatattgaactggctgatagctgcttacttgctcaaatcgtttgaccgtttcttttgagatggctggttcatgaccaagaaaaccccagtatatctcttctccttgtgtatgaagagcaacaagcctgtcaaagcgttttcgtaacgctagatttgccatcgctttcgcttctggctctgttagcggctgatatccaggaaaaccgcgattggacggttccttaggctcataacggtagtattcgatctcccaataagcaggaaattgattgttcagatccacccctcttatatttgctttccattcttgataatcagcatatcctccatgtagcgctgtgaattcttcactgctgagccctagtgactctggtccatttcgtacgagatccacgccatctggattcaccattggtacgatggagagagctgtagttcgcagaatatgaacggcttcatgatgtcttgcttgcaccgggtcagatgcagccaaacacagcgatttcagccattttattaaaacagaagtcgtgatccactcatttgcatgaaaagaggcattcaaatgaatagaatgcaaatgctgaacaggctctgttcggatttcataaataggtgtatcaagcactgaatgacctatgacactgatctgaagaaaaggaaatgcggctttcaatcggccaagctctttttctaattgaacactatcatattcaaaggttccattgatccaatcatcggattgctgcagcctgtatggcgcaataaatttctgcagctcacctatggaagaaaatgaatggatgccttccggaagtcgatatcccggtaaaaggagatactcagtgctgatatgattggataaatggaaagccgcactccctatccctagctgctttgccacattatccttttcctcttcatcaagctgccattcaattttcccaaacgacgttgtcttcatttacatccctcctctcatactatatgagctggcatacaaaaaaagaaaacctctgcatgtaaaaataacagaggttttctcatatgttaggacgcctttttcagcttcgtttcatcttcttttttggatggagaatggtccgggctgttccggtcataaaatctaaggagatccccgtagatgatctgatcagagaattggagctcttgctttgccttttcttcatatgactgacaaacagtctcatcatctctcggctcacccgtttttttattgtagcaaacaccatctgtgaaaacactgtccttcgtaataaagctgccatcacgaagcacggtaaagtcattcttatcttttgataaaagatcatgaccaaattggatttgtttacttgtatcgactcctaaaagattgagtatagttggacggatatcgatttgtccgcctactgtatcaatttcttttggctgttgttctgtgatccctggaatgtgtacaacaaacggcactttttgaagctgcacttcttcaaatggcgtaatctctttatttaaaaattgtcccattgcttcgttatggttttctgaaattccatagtgatccccatataaaacaaagatggaattttcgtacaaacctgtttccttcatcttttcaaagaaaatcttcagcgcctcatcttgatatcgcactgtcggaaagaacttgtttaacgttttgctcttagaatcatattcatcaatcagcttatcttcttcgtctagatcaaacggaaagtggttcgttaatgtaatcaatctcgtatagaaaggctgcgggatcgatttcatcaattccgctgactgttcgaagaatggaccatctttcagcccccagccaactgaattttcttcatttacatcaaatgatttaatatcaaaaaacttgtcgtagccaaagctatcgtagatcaggtcacggttccagaaacttttgttattcgcatgaatgacagaagaatggtacccctcatcctttaacagctcaggtgtggctgtatactcattgcttggatttgtgaagaacacagcccctcttccaagtggatagagagagttatcaacaataaactccgagtccgatgtttttccttgccctgtttgatgatagaaattagtaaagttgtagcttttcttgattagtttgttgagaaatggtgtgatttctttcccatttaatttttcattgaccacaaagctctgagtagactcaagtgagacaaggatgacatttcgtcctttagcttgaccaaacgtcttttcattacggtcggtttgatttgcgcttacatagttttcaatttccgttaagctattgctgtcagcaagggctcgctgagcagactgcttcgattgcagcactccatcataaatatggaaattatataagctaatatttttcaccagcatctcacggtcaaatgagcgagtgagcagttctggtctttctgtttcagccaaacctaggttaaagaagaaagtcgctgccacaaataaataatacgctgctcgttcttttcgtgaaatggtgacatccgttctaaaggaaggctgctttttatagagccacattaaaatgatgatatcaacgaacatcaataaatcgactggttcaattaaagaggtaatacttgacccgaggtcacccatattgtttgtttgaaataggacggggatggttagaaaatcactatagaatcgataaaacacaatgttagctaacaaaatgaatgtcaaaataaagctcatgacgatgatatatcgattgcgatttttttctttcataaataaaccgataccaaagataaacaagagaaagcttagcggattaataaacaggataaattcctgcatgaaattttctattttaatattgaagctagatttatagataacataggttttgacccacatgagcaatgtcgcaatcagtaaaaatgaaatcgcctttaatcttttctttcgcattgtaacctccttatgctaagcgagcactcaagctagggatacaccctaattattggtgcttcttcaaaaataactaaactatatcttatcctgtatgtgctggaaaatcaatgtctttttcctcatgacaaacttatgaatatgctaaacatttcatttcatgcccatctatcgctttttttaataaaaatgacatcatgatgacttttttgtttaagacaaccatttgttttttgccatccatgcaccgccgatgactcctgcatcgtttccgagagaggcaatcacgacttcgacatcatcagcgcaaggcggaaatgcgtgatgcttaacaacgcgctctactttactgcgaagaatctcacctgcttttgaaacaccgccgccaatcacgatttttgttgggtttaacgcactggcaagattcgctaagacaaggccaagatgagtcgtcacttcttctacgacacgcatggcaaggtcatctccactttcagcggccttaaacacatcctttgcagtcagcgaggtgagtgtgcccagtgaagatgtatgctgctctgtttctaatttatcctttgctagccggacgatgccagtcgcagatgcaatggtttcaatacagcccgttcttccgcagttacacggtgctccttggaatggaacggcacaaatatggccaatttctccgccagcccctgtctccccttgaacaacttcaccatttacaataataccgccgccaacacctgtaccaagtgtgaccatcaggatgttttttgcgccatcgcctgcacccttccacatttcaccgagtgcagcaatattcgcatcattttcgatgacagatggaagtcctgtctctgcctctaggtgatctttgagtggatagtttgtccagccgagattcgttgttttatagacaatcccagatactttatctacaggcccaggtgcacccattccaatcccaatcagcgctgatttgggcatactgatttcgaccaatttgtggtcaattgatttggcaatatcgactgtgatcgtctgccctgatttatccgtaggaatttcccacttatgctgaatttcaccatatagattaatgaacgcaagcttaattgtcgtaccgccaagatcaactcctacaaaccaatccccgatcatatgccctccaccttcacattgtttttcgatttaatttggctagttccatttgaagaatcgtcattgcgtttgaccattcggtccggtcaataatgcccgatgtatacatttccttcagttcatctgccataaattctaattccacttcacgatctccgaaatacacataatttccaaatctcatgagcagctgctgtacatcatataacgttttcattgtttccaccatttcttctcatcaacagataggataagcgtattcataaatgcgctttcagtcaagtcattcaatgtgtttgcgtgttttcaatatattgtttcagctttaaaaattgatcattttttggatcttggtctaatcctttttctattagatcctctgctttcgctgtctctcctttttctacgaacaacaacgataaatgatacagtttatttggatcatctggatcttttttaagcgacttttgtaaaaatccaatcgctttgtcaaggtggccgagctgggcttccgatagtgcatatatatggagagcctcagctgatgcatccttttgatgtacatattcctctaaacgtttacttgcttcgttatagttcttgtcatcaaatagacttgctgcctcacttactgccgccgcttccttttgatcatctgaatgaaaccctgtatacaatccaaaaccaccaatcaatagtagaacaatactagcaagaaacattttgacaggctgcacctgtttagggagacggacagctaaagcagctaaaaaaccgccaaccagaccaccaaggtgccctgcgttatcaatacctgatacggtgaagccgatccctaaattgatgaggatgatcacaataatatttgtccccatcgtccgaaagaagagcttacggttagagattgccaaatataatagtgcacctaagcatccaaagatcgcacctgatgcaccggctgcgatggcggtattaaagacaaagctcgctatggaaccaaaaatgccggaaatgaaatagatgagcacaaatcgccatgaaccataaattctctcaacagccgctccgacagaccaaagggcaaatgtattaaagagtaagtgcgtcaagccaatgtgcaaaaacattggtgtaatcaggcgccaccattctccctctaagatcagcccattatttttagcaccaaacgctgtcaaagttgccgtattggtacttccgccaaatagttcaagtaaaagaaacatcaccacttgaacagcgatgagcaggtaggtgaaaatcggtctgccattttgaaaaacggcccgttctcgttcacgctgcttttcctgatcatcgaatgcttgaagtacgttcactttaagctttatgacatcttcagctgtgtctctttttgcctcttctacatccactgtcaacgatgtattgagccatttttgcagctcgttaacgtcgtgttgaagagtgtctgcattcaataatactggtgtaaccgtcaccttttgctttttttgcggctgaccgtttaggtcctcccaatcatctacagggtggtcagctgtaaattggagctgtaagagatgaagagaccgtttacgcatggcctctctcagctgattcatccgatacgtctgctcttcgatatctcgaacaatctcctgtttaaaattcacatcttttctatatagacggataagatcataccctgagtttcgtggtgcttcgaaaaatatttcatcttctggatacggactttgaatcatctcgtaccctttttgtcttaattcatcaacaactcgccaaaataaactatctatgacattcattcattcgcgctccattttttacattattataacaagaatcgttctgatccgcatttctgaacaaaaaaatcccggcgtctgcgggattagaatgcttggcgaataaatttcgtccgaaaatatgggattttcatcagccacttaataaaaaagtgacgcacttgattttgacctaagatcaaattcatcagccgataacgattttgcacgagaacaaatgcaaacaatgtgaacacaatgctccaaatcattttattcatcatattccctcctatgttcgtatcgtggcttaaataggatgtgtttatgcatgaaccattatttttatcgcttaccatgcgatctgctttcacactctaatcccttgttcttttgattgaatataatagacctcttcacactctgattgatcaaaagaaacgtcaaattgatgaaggtcgattaaatccttgaacgtatgaggcagtttacaattccgctctaccacttcgatcttatgcgggaaataactgtcgtatggatttggtgtatgtacatatacagcgtccaaaccagggtcatgttcgtgaatacaaatccatgtttggtatggcttttcaaagccttcaagctgttttaacagcctatgatataaggtgatatgggctttgatatgctctcttcttatttttaagctattttccccgactccaaaaaaatcaaggtgcgtatgccaaaaataaaaccatgaatcctgatcgagttttaggtcacaagtattgacttcctcccgcatattgcggaagtatcttttctttccacgaaattttttcaaaacggacctcctatcagctaaaatgaaatgactgtatgaaacaacaaaaagcccgttctttggacaatcagcggacttttacttttgatataacgtacctttttcactgacaattatagacaccggtatgtcgtgtgcttcagatggcacatgcctaatttgctgtaaagacagacaaagtgcaatggtgacgccgtgaaagtcagctaagtagcggtcataatagccgcccccaaatccaatccggtagcctttttgatcgaagcatactccaggcacaatgattaaatcaatggcttctttatgtacagctgttgatacttgaggatctggttccaatagcccaaagtagctggatgtcatctttgtttcgggtgtatattcataaaatatcatctcttttgttttcggaaagcaggtggggatacatactgtttttccttcttcccacgctttttcaatcagaggcattgtcggtatctcttttcctctagacatcgtcaaagcgatcgtttccgcctgtttccatgctggcagctgcagtaaatgctcatgaagtaaagccgtgctgcgctcaaattcttcagcgcttatctgatcaagcttggctaatgtttgaaggcgaagctcctttttcatacagatcatctcccatcataaaaaaacagcaggaaaattccctgctgcttactttgtttcacgatgtacagtttgttttttatcacgtgagcaatactttttgaattcaacgcgatctggattgtttcgcttattctttttagtaatatagttacgctcaccgcattcagtgcaagctagagtaatatttacgcgcatatttttccctccaaactaaaatcaattcacattcagacctaactataataccacttctagcttaggaatgctagaatgttttttcaccaatttcaatttgagtgcattcacttacatatcgtatgcttatgtcatgaaaaatcgtctgctcccctataaaacctgatcctttgtcgtactgtatacatgggacccttcttctccccgccgctttcatttattttgacagcgaggcaaggttttcatacccgttttacatataaaaagaaaaaagatgaaaaaaaggtgattttcttcagcaattccttttgaaactagcttttttatggtataaaaaagaagggtcgaaaactgtctgaaacaatcttgaaagccttttatggctttcagcattaaaatatgaataaaaggtgatgaaacatggaaattgcaattatcggattgcttgttgtcagtattgtactgatcgcattctcatattttcaaagagagccgattaaagaagtcgagcaggaacttgaaacacttcaactatctgcaatgcaagaaatctataaactgaaaaagaaaatgaaagtgcttgaagaagaattacttgaaacaaacatcgttgttcgccagcattctgaaattgatccatccatcgcaagacagatcatttcaaagcatcaaaatggcatgtctcctgaggccattgcgcgcgctgagcatgtatctgtagaagatgtcaacatgatcattaaagacaacgagagggtgcttgtatgacgaaaaaaagcatccaaacgtttgcagcaggtataattcttgcaactggggttcttgcgattgtctttttcctcactgggaaagacgaggcagtagctgatacaacaacaaaagaaaccctcgcacagaaagtaacagacactgacgtgaaaaactatttagactccaaaaaagaagtcactgtcagccgtgaaacgtaccagcagcttcttgactataaggaaaaagcgctgaaggcaaatgaagaagacggcgattctaatagtgatcaacaaaaagaggacaagcctaaaggcaaatcgatcaaattcgtgattaaaaacggtatgagtacaagtgatgtttcagacatgcttgaaaaagacggcatcatcaactcgtctaaagactttaatgattacgtaattgacgctggctaccataaagaaattcgtgcaggcaaattcaatttaaaaacaggaatgacgttcaaacagattgtcaaagccttaacaaaataacaagaaaaaccccctggcggcactgacctccagggggtttttcttatccaaatcgaccagatatataatcattcgttctttgatcgtttggctcagaaaacatcacatttgtatcattgacttcaacaagctctcccattaagaagaatgccgttcggtctgatacccgagccgcttgctgcatgttatgcgtcacaatggcaattgtatatttctctttcaatttcataatcaattcttcaatctttaatgtggagacaggatcaagcgctgatgttggctcatccattaataagatgtctgggcttgtggcaatggctcttgcgatacaaagacgctgctgctgaccgccagaaagacctagagcgggggcacttaatcgatctttcacttcatcccatagggcaacatctcgaagcgctttttccgcgatttctttcaattgctgcttgctctttactccatgaattcttggtccgtatacgacattatcaaagattgactgaggaaatggattccctttttgaaacaccatgccgacatttttacgcagctcgactaaatcgacacgaccttttaaaatgttgtcatctttatacatcatatccccggtgattttcacacctggcactgttttgaccataagatttaacgttttaataaacgttgactttccgcagccggacgggccgataatcgctgtgacttcatgctctctaatcgctaagtcaatatgcttcaatgcatgatgctgtccataccaaagattcatatcattcacacgaaacacttctttttttgctgtttcagttgctaccgcattcatcaaatccacccgccttatccaaatcgaccattgatatagtcttctgtttttcgctgcgcaggacgtgtaaagatacgttctgtggcatcatattctactagatctccgtttaagaaaaaggccgtacgatctgatacacggagcgcttgctgcatgttgtgtgtcacaatgacgattgaataatcatttttcaattcgcctaatagctcttcaattttcgcatttgagatcgggtctagggcagaagccggttcatctaatagcaagacactaggtttcatcgcaagtgtacgtgcaatacaaagacgctgctgctgaccgcctgacaatgacaaagcggatcggtgcaaacgatctttgacctcatcccataacgccgcctttgttaagctttcttcaaccgcatcatcaagcacagattttcttttctccccggcatactttaacgcatgggtaatgttattgtagatcgatttaggaaatggatttggtttttggaagaccatgccgatttctcttcttaaattcaccacattaatacgatcatccaaaatatttaatccttcgtacatgatcgccccttcacttctcgcacctggaattaagtcgttcatgcggttaatactgcgtaaaaaggttgacttcccgcagccggatggaccgattaatgcagtaattgcattcttctcaatctcgaatgaaatttgattgaccgctcttttttcaccataataaatgcttaaatcctgcacctgtaaaatctgttccgcttgaagtggagcctttttcgcagcaatctcttttttttctgctagcatttgaaccatatccccttcacacctctctcacattattttgacgtaagctttttatgaataaatgaaccaagccatctagctgctaagttgaataataagactgaaagcacaagtacagctgatgcaccatttgcgatggcttctgcatctggaatgattccttgtgtattgacgttccatatatgaacggctaatgtttctgccggtctaaacacattcagcggtgacgtatcagaaaaaggactccagtttgtgaaatctaggcgcggtgtggagagacctgctgtaaaaagaagggcagccgcctcaccaaagactcttcctgatgctaaaatcgcaccggtgattatagaaggaagcgcacctggaataaggaccgttttgactgtatgccacttcgttacaccaagcgcaagtgatgcttccttttgatccttcggtacagagcgcagcgcatcttctgtcactctgaccatcaccggcaggttaaacacagtgagcgcaagagctcctccaatgatcgtatagccccagcctgttaaattcacaaacatgagtaaaccaaacataccaatgacgatagacggaagtgaagacagcacttcaatacatgtacgaataaaatctgtgactttgttttgaggcgcgtactctgccatatacactccgccgccgacgccaagcgggactgtaatcagcatcgtaataaacaaaatataaaacgagttaaacagttgatccctgatgccgccgccagagccaatcgcacttgagcgggttgtcaaaaagtcgaaatttaattcttttgcaccgttaaaaatgatataagaaaacaaaccaacgagaatcgccgtaataatggcagcacataatccaaatataaatgtggcaaaacgatcggtcattttgctattcattaaatcttcctcctagacgacaagtatctgataatgagtatgaacataaatgatacaactagaaggacaagtcccattgaccaaagtgtattgttctcaacacttccatacgttgtgtgacccatgtttaacgtaataatggttgttaatgtaccagctgtatccataatgctctctggtaaattacgcgtgtttccaatgaccatctgtacagcaagggcttctccaaatgctctagccatgccaagaacgaccgctgtcattaatgttggcagagctgccgggacaagcacacgtctaatcgtttgccatcttgttgcgcctagtgcatacgatccctcacgtaaactttttggtagtgaacccattgcatcagtcgcaatggacgtaacggttggcaggatcataatagacaggacaatcgttcctgctagcacactatgccctgagccgcttgacttgaaatgtccgataaacggcaccaatactgtaagacctatgaatccgtaaacaacggatggaatccctacaagcaattcaatgactggctggaggattttacgtccccaagcaggtgcaatttctgtcataaagattgcgcctgcgatgcctagcggtgctgcaatgagtgccgataggagcgtgacggcgattgatccgaagataaaaggaaatgcaccgtactgcgggttttctgctgttgggttccaattgatactggttaagaactcaattgggcttacaccatttacgatgaaagattgtaaacccttaatgccaaggaagatggtgatggcgatcgagacagcaatcattaagaatgcgcaaaatctcaccaaaatacttcctcttacttcatccatttgcctatttttcttcgagctgatcagtcgatcgctcgcttctgtatgttctatctgcttcatctttttctacactcctatgaatgtcataaaaggaaaagtgaaaagctccacttttccttcatcagcaattcaagacctcttacttatctgtttgtttgcctgttgcgtctctttctactttcatattagaaactgagatgtagccttggtctttgacgatttctttttgcacttcatcactcatgaggtaatctaagaattgttttgctagaccatctggctcaccttttgtataagaatgctcgtaagcccaaattgtatatttaccgctttctacattgctttcttccggtttcacaccatcaatgctaagcggtgtaattttgtcatctgttaaataagagaatgctaggtatccaatcgcacctggtgtttctgcaatcagttttttcactgtgtttgaagaatcttctgtgattccttctgcaggtgttgcaccatcaagtgcatacttcacaaatgttgcacgagttcctgaagagtcaggtctgttcacaagagtgattttttgatcttttccgccaagctctttccagtttttgattttaccagtaaagatttttttcaattcgtcctttgtgatgtctttgacacccacttcagggtttacagctgcagccattccaacaactgctactttgtggtctgttaaagcttttgcgtcgattccgtctttctcttctgcgaatacatctgagttaccaatttgtacagatccttctgacacttgagaaagtcctgttcctgaaccgccggcttgtacttgaatatcggcttttggatgtttatccatgaatttttctgctgccgcaagaactaaaggctgcatcgcagatgatcctgagatggtaatggaacctgatgcctcttctttgtttgaagcatttcctttactgtcttttgaatctccgcttgagctgctgtttccgcatgctgtaacgaatgctaacaatgcgatcgtaaggaaagtaagcagccataatttgttctttttcatttcaagaataccccctgaataatttgtcctacgagtaatacattaaaggttctttattaatttcgtttaaatggattgttaaggttttgtaaatgtcgaagttttatagagatcttgcgatgttttttatgtattttgtcaatttatctcggagtttttgaagaaaacgtaaaaaaacgcccacaaaaagtgagcgtttttacctagagaaagtctagtcatttgtttctgcttcattttcaattttatttttgttcttcgcttgtgtatcattgctttcctgttttgattttagctcaaagtatttgtctaatacttgttcaccgatatcatttgtaattggatagcgctgattgtagtcttgatacacccatggtacaacaacagaaatggccacttctgggttatcagcaggtgcatacgcaacaagagtggtgttatacgtcggtgtgccgcgcttgcttttaattgggccgtcatagaatgattgagcggtccctgttttgccagctgggttatactttttgttgccaaagttcgagtaggctgtccctcttgggtcctgcatgacaagcttgaacccttgctgaacacgcttgatctgatcacttgtcatgtctagtttattcaatacgtctggtttgacggattctgttacagcaccaatgccgcgctgcggatctggctctctcacttctttcacaagctgcggacgtaaacgatagccgccattggcaaccgttgaaacgtattgcgccatttgcagcggtgtaaacgtatcatactgtccaattgcatagtcaagcaggagcccagattgtgtagacgttccccggtagcctgtcgcttcgtttggcaggtcaatccctgttttgaccccaagaccaaatttactgaaattataacggaatgtatcaaaagctttcggatcgattgggagcggctggttcttacgatactccccttttccaacggcaatcgctgttttaaacatatacacgttagatgaacgctcaagtgccgttaaatcattaatgagtcccatattttgataggatttcttaggcggtgactgcgcgatgtacagcggttcatcgtactgggtacttccaatatgaatcacgcctgttttatagccagtcagtacagtggccccttttacggctgagcccatcgcataggatgatgtcattgttcccagtgcgtagtcatcaaatttgtattttccgtttttgtttgaaatctgtttccccgcaacagagagaacttctccatttctagggtccatcatgacaacaaacgcacgatcaagaagctctgtcccgcctctttgtttcgcacttttcaagttcttttcaatgattttttcaaccgctttttgcagctgaatatcaatagtgagcacaaggtctttcccgctctttccttctgttagcactttagagcttgtcacattaccctctttatccgtcgtgctctgttctttttccttttgtccttgcaggacatcttcatattgatactctagatagctttttcctacacggtcatttcggctgtagccgagcgataaataatgttcaagaagtgactgtggaagtccttcatcacttgaggacacgctgccgagcatactgcgaagcagtcctttatacggatagctgcgtgaccagtctgttgtgacatccacacctggcagctcgtccaaatgctcagagacgtaagcaatttcgcttggcttcacatcatcatttttaatgaattgaggcgtaagtgcataacctgcatccatttgtcttttaatcgcaagcacttgtaagtcttttttcgtcagttgattcaattccttgtccgtgatgcgcttcagctgaagctcatataatttatcatcagcgaccttatcgtcaccctttaattccgattccttttgaacaagctttttcgcttcgttcgggtgcgttaaaatccagaaatcttttttgtcccgatctgtgatttttttcgtactcacatgaatcatatccgctaattttgtagccactttgagccgctcttcttgtgaagtcgtcgaggttctcgtatatgtaatggcatttagcgctttattgctgacaatcgtattatagtttcgatcgtaaatttttccgcgcggagcagatgagctgacattcacatcctcttgtttttctgcctgctttttataatcttctccattgacaatttgtacaaatccgagtcttacaacaacaccagtaaaaataataaacgcagctaaaaatagtaaattcagccggagtggaagtgttttgcgcccttccttcgcgtcttttttgtttttcttgtttctcatcacatcaccttttctatcaagaaagaaatggcacccctttttgtgtataaaaggtgccatcatcattttagcggtttttctattatttatctagaaatttgatgttccattggtaagaaattttacctttctcccttaataaggttcgtctgagaaactggcttttgaccgtctgcctctttcatatcagcagttttttctttcaaatgaatatctttaacaaagaaataaatgagggtatgtcccgctccaagcacaacaagagatgcaggtatcccaagctcatcaccaagtaaagtgacagacagaagaaacaacacaatggaacaaatacggcctgcatttaaaaacagctctctgaccacaatatattcaattcgggccttcctggcataccttgcatggccgatgacatcgtatgttaaggatacatatggaacaagcagaagcggatatcctatcgcgatggctaccgcatacatgagaagcgatacataggacaagtgaaagacgattaagaacaaggcgccgtataaaatcagcccgccaagcatgatggctttcttacgccactttttcttaatcaaacgtgtagcgaaaaaataagcgaaaaaggcaacacctgagttcactaaaccaaatgtcccgagagcaagctcactgtttgttgcgataaacacaaagacactaattaagaagacaaagaccccttcacgaagcccttgaaaaaagtgagctgttgtaatcttacgccaattctcgtcggcatggcgttctttccatatttgcttgatgataaatttccctttggactgccttctcttgaggaaaaagctcattacaaccgcaagtgagaacaaaaaaagcgataacgtgaaaatcaccgtatagcctgtatcatccgttaattgagatatgacaatccctgcaataagaggaccgatcatcccagctgtagatgacagcacaccgagaaacccattaaagaaatctcttgtttcaggctcggtgatctcaaaggtaagtacgttaaaagcaagccagtaaaaaccataaccgattccaaggacacttcctaataaaacaagccgcgcggccgcttgttctcctgctatcaagacaattaagtaaaaagcggctaagaagataacgccgaaacgaagaacaaacgcccggtctatttttttagcgagccggcctgcgaataaaaatgtaatgggctgaagcacaacaatagccagattgtaaatcgcaagatccgtaaatttcccagactgtttccataaatacacgtttacaaacgtatttgaaagcgcaatggcaagtgcatataatccgccaatcgtgaggaggagcattaaatctcttgtaacatccatgtccccgaacattttctttaatctgctcatatatttcattctccttttctacacaatagtctgtctcatcaaaaggcagatatgtaaaaaaaggagggaaaatataaaaagacctgcttcactaaagagcaggtcttttcaagtcaaatgatttatttagcttcgctgtaaaggcgagctacttcatcccagttcacaacattccagaaagctgaaatgtaatcaggacgacggttttggtagtttaggtagtaagcatgctcccaaacgtctagtcctagaattggtgtttttccttcagttaaaggagaatcttggtttggcgtgcttgtgatttcaagtttgccattgttcacaacaagccatgcccaaccagaaccaaagcgtcctgcagctgctgcagcgaaatcagatttgaatttttcaaatccgcctaattctttttcgattgcatctgcaagttcaccagttggtgcaccgccaccgtttggtgaaagaagcgtccagaataatgagtggttagcatgtcctccgccattgttacgtacagctgtacgaacgttttcaggtacagagtttaggttagccactagctcttggattgattgatcttcaagagctgatacaccttcgattgctttgtttaagtttgttacgtatgtgttgtggtgttttgtgtggtgaatcgtcattgtttccttgtcgatatgtggttctaatgcatcgtaagcatatggtaattctggaagtttaaaagccatggttaaattcctccttagaaatgtatgtactgaaatgcttccttaattcataagcaagcaattcaccctactcaaagagtatcaaaagaattggcttgtttcaacgttattgctcatgatctgtaacatttcagtgtttattttgtatttagccctttagaaaaagttttaaacgccctttttctatttatcgaaggacataaaataaaaagatgcccagcatcagcgcttggatcaatcctttggcaaatacacctgatataaatccgattaatgagcctaatcctactttcacacttgtcttcacatctttttgatgaacaaggagctctgcaataacacttccgataaatggaccaatgataattcctgcaatcggaatgacaaaaggaccgactaataacccgatggtgcttccccaaatagctgcacggctgccgccaaaacgcttgaccccaataagattcgagacataatctgccgcaaataatactgcagtaaatacggcttgaatgagccaaaacgtcagtgtcagcggctcgaagctgaaaaagaaaccatatagaataaatccgagaaccataaaaaccacgctagggataattggataaacaagtccaacaaatgcaatgataaatgcacaaataatgagaatccaatacaacacatccaagtcacagccgcctcctttttatttgctgtatacattatgcctcattccctctatcttaaccagcaatgaaggccatacttgtacttgttagatagacattgatacaatatgagaaatagaaaagaatgtaggaagtgaattgattgaacgtatttaaacttttgttaaaaggcatttattcaccaaaagatattgctaaagcacggtttacagggattggcaaagcgattttattcatttttatcctttcgattatcgcagcagttcctcagggttaccacatgagtcaagagatctcgaatgcgatgtcaggatttcagcatgtgatcaaaaaagatttacctgatttctcaatcgaaaaaggaaagcttcaagcggatcaaagtgaaccgatagaaaaagaagaaaacggcattacgatcatttttgatccagctgaaaaaataaaagcaagtgagcttgaatcaaagcaaacagccatcgcattattaaaagaaaaagcagtgattgccattgatgggcaaatgacagatatcccgtatcagctgcttggtgggacgctgacaaaagacgaacttgcccgcgttacaaatcagaatcaagcgattattatcccagttatctgcgtgctgctatatctatcaactgcggctctcatgttcattagcgcaactttccttgcgatgctcggtacatttattaaacgcatgcagcaaaaagagctgtccttccaaatgctatggaagctctctgcttactcactcacattaacaaccgtctttttcgccatcatgagtgcattaaacacacctgttgcgaattcatttttattaaattgggtcattaactttatcttcttataccttgtcgtaaaggaaatacccgctaaaaataaaccacttgccaaaaattaatttagtatacgaaagctcccccaacttggaggagctttttatgtatgtgcatgccctatgattcatccggatgaatgatcgcaaacaaataatgatcttcccatacgtcattaatctttacttttttacgattaagtccctcattttcaaaacctgacttttcaagcacacgaatggaacctatattactcggctttactccagcttcaatacgatgcagatgcagctcttcaaaggcataatcgatgattaactgaatggcttctgtcatataccctttcccgccatgcttttcatcaagtacataccctagccaagctccttctatcggacctctttcaacagaacttaatgagattgtcccaattaaggcatctgtttcatttaagaaaataccgtgcatgtaggcttcatcctgtgcgcattttttcacactgcgctgaattcgttcaatttgacgaggtaacgtgaaaaaatcatctttgaccaaaggtgtaaattgctgaaaataggagcgattctcaagctcaagtgtaagtagtgattgtgcatcttcttctgctagcgctctcacatagatctgctgactgattttcttcataaactctccccctgtttttattttatcataatcgtgatagaagcttgaaaaagcaccaccgagcgtaaattcaatgcaagactcactagaacgaactagaacctccctttccagcttttttcctcatgttggttctatcatttcgggacatgcatagactgaagtaaactcttaaaagcggtgagtgaaatgcggcgtattatttttttgctaatcagtttgtttgtcctctttattatcttttttgatttaaaaaatggcaccatccccgttgaagaaggtccagctgttcctgcaaatgcctttcaaacacctgagaaaaaagcatataagaaggtcacggtgaaacaaggtgaaaccgtcgtctctatcgtccatacaagtaagcctcttgatgaagtcattgaagattttgaagagttgaatcaaggcgtcaaagcaaacgaaattcgggcaggcagcacatataagtttccggtctataagagataaaacgttaattccttgtcattcatacaaagagactgttacaatatgaactgtaaaacaagacgtacatggcaaatgattgcttgtacactaaggagcgattgacaagtgagtgaagtcacacatcgtactaaaacgcgtcccgtcaaagtgggacctttaactataggtggaaataatgaggttgtcattcaaagtatggcaacaaccaaaacacatgatgtcgaagcgacagtagctgaaattaagcgtcttgaagaagcaggctgtcaaatcgtgcgtgtcgcatgcccagacgagcgtgcagcaaatgcgattgcagacataaaaaaacagatcaacatcccactagttgtcgatattcattttgactacaagcttgcactgaaagcgattgaagcaggtgcagacaaaattcgaatcaacccaggaaacatcggaagacgagaaaaagtcgaagcagttgtaaaagcagcaaaagaaaaaggcattccaatccgtattggggtaaacgctggttcattagagaaaaaaattcttgataaatatggctatccaacagcagatggtatggtcgaaagtgcactgcaccacattaaaattctagaagatctagattttcatgatatcatcgtcagcatgaaagcatctgatgtcaacctagcgattgaggcgtacgaaaaagctgcaaaagcatttgactaccctcttcaccttgggattacagaatcaggtacattatttgcaggtacggtcaaaagtgcagctggtctgggcgctatcttgaatatgggaattgggaacacactccgcatctcattaagtgctgatccagttgaggaagtaaaagtagcacgtgaactgttgaaatcatttggtcttgcagcaaatgcagcaactctgatctcttgcccaacttgtggccgaatcgaaattgacctcattagcattgcaaatgaagttgaggaatatatctccacgattaaagcaccgattaaagtagctgttcttggctgtgctgtaaatggaccaggtgaagcgcgtgaagctgatatcggaattgccggcgctagaggcgaaggcctattgttccgtaaaggtgaaattgttcgtaaagtgccagaagaaacaatggtcgaagaactgaaaaaagaaatcgataaaattgctgaagagcattatgcaaaaatggaagctgaaaaagcaaaagccaacgcataacaaaaaacgcctgacgtcactgtcaggcgtttttctgttcttgttaaaagaacggggtgataaatatgccaaggatgacggaaacaattccgatcccaattgaccatgcgccaagcgcatgtgctccttttcttcttgcaatataaccaacgacgattgccgctactcctaatagcaccggcaagacaaataacgagataatcgcaatcgcgagtgctgtatagcctatccccttactgcctgaatcgtcacctacttggtcacgttctcgtctgtctactcgatctcttgaagcctgatatggctctgcaatttcagcagctgtttcctctagatagccatcatcattactaaagtgtgtatcgatttcacgatcatttcttctgaaatcttcgtctctttccatgatcaattcccccttttggttaatagaaaggagcttttttagtatgagcaaaaatgtctgtttcatgtttgctaaaacttgctggaattgtgaattgattatgttacactttaagagtataaaaatgaggagtgtgggcatgttacgtttaggaattgatatagatggcacagtgacggcacaggacacctttgttccctatttaaatgagtcgttccaatgtgccatgacactagatgatatgacagaatatgatttgacgaagcttttaaatatttctcaagaagagttttggggctggatgaatcagcacgagcctcttatatataaacaggcacagcctgctaaggatgcaaaagagattcttgatcaattgaaacatcaacataggctgatctatattacagcaagaaggcagcatcatgcggatatcacctacgagtggtttcacaaacatcacgtgcactatgatgacattgagctggttggcggtcatcataagctcgaagctgttcaaaagcacaagattgatgtgtttttcgaggatcatcatgggaatgccaccatgattgcaaaagaggctgacatcccggttattctttttaactccccatataatcaaatgcctattgatgacagaattatacgcgtcaacaactggcaggaagcgtctcaatggattaaacaatacgagcagcgtttggaaactgcttattaatacagaaaagccgatactctaatgtatcggcttttttaatgaaacaaactgcccttctttcatgagaaaatggtacagtgctcccttcatgcctgcctgattcaagtagtagcacgtttccagtttcacctgaatgttcttccacgcatgcagtgtatgtaaatgtttctcaatgtttgatagcaaatctggtctggcactaacgcccccgccaatgagaattttctctggattaaggacagttgctacattgtaaatgccaatggcgattcgcttgtaccactgatccaccagcttttcaatggacggatcattttttgccttttcaaaaatgtcttgaccgtctatttgcgtactttgcggaattccttgcttttctttatagctgcgaattaaaccagctgttgaagcactgctgttgagtgttgtaaattgtccattttctgtctctgtcagcatcatgccaaattcaccgccgcgaaaggaagccccgcgcacaagctgaccgccagcgaaaatacctcccccaacacctgtgccaagcgtcatacaaataaagctgtcacactctttcgcatgaccactatatttttctgcaagagctgcacagttcgcatcattttccacttccacacgaagcgatgttttctcttctaaaagtgtttttacattttgaccatttaaggcgatgatggctcctgcaaattctgtataacctgtttcactgtccacaaagcccggaagactaatcgcgattccgctgacatccgacgttctctgatattgcttgaccacatccaccatcgcttctaaaaacggttcaagctgccggcagctcgtttcatagtcaccgctcgtgacaagttccccatcctgatccattaaaccatgttttgttctcgtcccgcctacatcaaacacgacataatacgccatttttgaccctccctttaccccaaaagacacaaattgcttcagtaccttgttctcattttaatgaaacagccgtcctttgtaaaacgttttcaaaaagataaaagaaacagccagctctgcggctggctgttttatgaatgaacttccttcggttcacaggaaggacacgttccgtatatttcgaatttatgtccgctaatgtgataatcctctagatcggcgtctaacttgtccatagggcaggcatcgatctcctttgttttaccgcatgtcagacaaataaaatgatgatggtgatgagaaaatgagcatttaaaacgaaaaagcttctcccctgacaattccgttgtttctaatatacctaagtcttcatatagcgacaggttacgataaatcgtatcaaagctaagacctgggtagtcttcacttagtgccgtcagcacatttttagcagtcaaatatttatcagaatcagaaaacagttgaagcatgtcttcacgtttgcttgtatacttgtagcctttttcctttaataaatcaagcgcttcttgtacgttcatgatgattcccccttttgaattttccaataaaaatacatccgattaaaatcaaaatggacagcatcacaatggttccgcctggtgctaaatctagataatagcttaagatcaatcccgccaatacagacaattcaccgaacaagattgaaaggaagatcgcctgtttgaatcctttggcaatgcggatacttgccgcaacaggaagtgtcatgagcgcagagacaagcagtgtacctacgatacgcatcgacgccgcaatgacaagtgcgacaactaagataaaaataaaatgaatccatttcgctgaaataccagaagcctttgcatgctcttcatcaaaagaaagtaaaaataattctttatataaaagcacgacaactaacacaacaacgagtgagatcccaacaacaatccaaagatctaatctcgacaccgcactgacacttccgaacaaataactaaacaaatctgtattaaagccattcgctagtgaaatgaagatgacggaaatcccaataccgcctgataaaataataggtatcgccagttcctgataatgcttatacacagaacgcaggcgttcaataaataacgaaccggcaacagaaaacgccatccctaagtacagcgggctcacccctgtcaagaggccaaactttttatcaaggaataaactagctgcaataccggcaagtgatacgtgactgagggcatctgcaatcagcgagagccttctcacgacgataaatacaccaagcaagggcgcaataaagccgatcagcattcctgcgataaacgcattttgtaaaaactcataatgaaaaaatggaaatagcattattcatgtcccccatgatggtgatgatcgtgatgaatcacttgaatgtcatgcccgtaaaattgggataacgcttgatcatccattgaatcaaacgtttctgcatctccgtggaaatgaagtgtctgatttaagcaagccacatgggtgactttatcagaaacagtgcccacgtcgtgtgtgacgagaattaaagacattcctttttctttgttcaatgtttctaacagctgataaaagctttctactgtccgctggtctacgccaaccgttggttcatctaaaatgagcagtttcggctgactgacgagcgcacgtgcaataaaggcacgctgctgctgaccgcctgaaagttccccaatgttttgatgcttcaaatcttgtatcccaactgagcgaatggcatcctcaacttgccatttgtcctgcttgctcattcgtttaaataatcctattttcgccgtcaatccacttgcgacgacttcgtaaacagaagcagggaaacctgtattaaaactattcgccttttgagaaacaaatccaatttggtcccagtctctaaatttagaagcaggcgtgccaaatagttttaattcgccttgctgtggtttaatgagcccaagcaggcattttaataaggttgttttaccagatccattcggtccaacaagtgctagaaagttcccttcctctactgtcaaatgaatgtgatctatgacatttcgctgtccatacgagtacgaaatgtccttcatttcaataattggctttgccatgaatctttccacctttaatcaatataaaaagaatgattacgatttatacaacaaaaagaaaatggcttttgccattttctctgtccatacatacatttcattatataaaagaaagattaaaaagtaaaataaaagctaatgaatggctgttttgaacttaccgccttttgtttcatgcgtatccataattgtaataaatgcttgactatcaatttcaaatacaatggattttagctttgtaatttcaagtcttgtgacaacggcgtagatgacatctttttcttcatctgtataaccgcctttccctctcagctttgtcgttcccctgccaagtcgatgaagaatcgcatctgaaatttcatcataataatctgatacgataatgacagcttttgtttcatcaagcccttgaatgacagcatcaattgttttcattgccaaataatatgtcatgacagaatacatagcctgctctggtccgaaaacaaagcctgcccaaataaaaatgaacacattgacgatcatgacaaactcaccgacggaaaaaggaatttttttcgttagcagaatgcctaagatctctgttccatccattgagcctccattacggatgacaagtccaacaccaaaaccaagtaatagcccgccaaatacagtagctaagatcggctgattggtaaatgcctctacatgatggagtgaagattctatgacggctaagctgacaatcccaatcacagtggaaataagaaacgttttcccaatatgtttgtatcctgatatcataaatggaatatttaaaatgacaacaatcgtcgcaaaattgatgaatgggttatctgtaaagagataatccaaaataagcgaaatgccgatgatgcctccatcgataatattgtttggcactaaaaataattcaatgctgactgctgcgcatgtagcacctactagaattaggaaaattctaaatataaaatgaggcactgattcctttctatgctgtttactatttgccatacgttctcccttctacacatgttaaattttcaatgaacattttattcactttactattttatcatttcacagggtaaaataaaattttttgcacattttccgttttcgcccatacattgttacagaggggaggaatggaattgattttaattcaaaaaattgtcctgcagcggctcaatcagatcacagcaaatgatctgttaaggtatgcgaaacagtatggtgtcagtttaacgtcaaaccaagctgctgaggtggccaaactcatgaatgggaaaaacgtcaatatttttaatgatgcagagcgtagccggcttcttaagcaagtagaagcgattacatctaaacagacagctcagactgtcaatgatctgtttaatcagtttacaagttaagaaaaaaagggccgcatttagcggcacctcatgatgttgtatgctttttactgatctttaattttatctagtaagcctccgtcaaattgcttttcttttagcatcgcaatttcgaatttgtaaggtggttttttgttctttttatcttcacctacataaggcgtttctaagatttttggcacatcttgaagctgcggatgatgcacaatgttgttcagtgcatcgaagccaatttcaccaaagccgatattttcatgtcggtcttttcttgcgccttgtacgtttttactgtcattaatatgaagaaccttgattcggtcaataccaatgattcgatcaaattcttctaacaccccatcaaagtcagtcacaatcggatagccagcatcgtgtgtgtgacacgtatcaaagcagacagaaagtgcttcgttatgtgtcactccgtcgataatttgggcaagctcttcaaagcttcttccgcactctgaacctttgccagccattgtttctagtgcaatttgaaccttttgcccttttacgatgacttcgtttaaaccttcaatgattttttggattcctgcttctggtcctgctccgacatgtgcacctgggtggagaacaatctgcctcgcacctagcgcttctgtacgttcaatctcagagcgaaggaagtccacaccaagctcaaaggtcgatggattgacggtattcccaatattaataatatacggtgcatgtacgacgatatctgtcataccatgctctttcatatgcgcttgtccagcttcaatattgagatcttcaatttttttacggcgcgtattttgaggtgcacctgtataaatcataaacgtatttgaaccataagaggcagcctcttgactcgctgcaagaagcatatgttttccgctcatggatacatgtgaaccaatcttcaacaatgtttccccctactttccattacgctttgactttctacgttcctgtcttttgattttgtccatctcacgtgtcattttctttttataaccaggtttgacggctttcggttttctcacaagacgctttgctttttcttcaatttcattaggtgcttttttacgtctttgacgcttcaagcggtcatctgcatctcgccattcgccatgaacaatggttttgttttcaaacacaacgcccattttctcgatctgaataagtgcatcctcatcagcaagctcataaatcgtcatcgcaattccagatgaaccagctcgagctgttctcccaacacggtgaacataaaaatcaagatcagatggcagttcatagttgatcacatggctgatgcctttgatgtcgattccgcgggctgcaagatctgatgccactatataagtgaactctaaatcatcaatttgcttcatcacttttttacgttcgcgcggtgttaatccgccgtgcagcaccccaaccttcattcctttttcttgtaggaatgatgcgatttcatcaacggttgtttttgtattggcaaaaatgatgcctaaataaggctgtatattcgtcaccatttcatgaagcaatttcagcttgtcacgctgtttagatggaactaaaatatgctgaatgttttcagctgtaattcgttttggttcaacatgggcatatttgggattgtccatatattttttcaggaacggctttagtttttctggaatcgttgctgagaacacaagcatttgcagctgttctggcatttgtgagccaatacggtccacatcttctaaaaatcccatatccagcattaaatccgcttcatcaatgacaagagatgtcgctttgtaaacgttcagcgcctgctcatgaatgaggtcagcaatacgtccaggtgtaccgacaaccaaatgcggctggttttttagcttttgaatggatttttgcttgtccgttccgccaatgtaaagcttcgctttaatctcttcttctggagaagcattttttaaaatcgtttgggcttctttgaaaatttgattagctaattctcttgtaggtgcagtaatcacgacttgtacgtgctctttgcttggatcaattgaatgaataagcggcaataagtacgcgtgggtttttcctgttcctgtttgtgattgaccaatcacgctttctccctttaacacagcagggatgattcttttttgaatatcagttggctcataaaagcccagttcatgaatagcatctataataaaagactttaattcatatgtcgtaaattttgtttcgttcatgttttcactccttaaggcaatgcctttttgctcatctcctcattatagctgattttcagcaaaaaaaccatgtccgcttttcttaaaggaaaccaattgatgcttcgttgcataacctatgaagagaaagagaatgcagtaagggaggtacaagtatgttagggcaaaggcctatgggcgattttcagccgcaccgtccctcacgccggcatcttggaaatggcggacagcccggaatttttcaaaggaggcagcaggctcctatcgaacagccttttcaagggcaaggcaatcaatttcagcaaatgatgcctcgctccccgtctgtacagggaggcggtgtacgcggaataggcggaattccaggaggcgaaagccgtgcactaggcggcggagcaggaatgaaaggcatgctcgctaaatttcttcctggcgcagggggagcaggagtctctggaggtggtgcgggtttacaaggaatccagagcttcgcaaatcctgcaaccctctcaagcatgttgggaaatgttcaaaaggtgctcggtatggcgcagcaatttacgccaatgattcagcaatacggtcctttagtcagaaatctgcctgcgatgattaagctatatagccagcttggcagtgcggatgatgatgaaactagtacagatgaagaacctaaagaaatcggcgaggaaacagaagtgcaaaaagaggttgcatcaggagatgatgaaatagaagaaaccgaagaaccagaagacatcctcgtcaaaaaaacagctcctcactcatcacctgctcctgaagtgaaaccgaaaaaaagacctggcagctctgttccaaaactatatgtctagtgatcttttaatggcgaaatgtcccctgcgtataacaacctttgatatatacgcttactttggctataatggaagctagagaatgataaaaagccgttttttcacggctttttatattgttcttctctagcagcacttccctacaggaggacgaataaatgaatgtaattaaaatttcgccgcgtggctattgctatggcgttgtagatgcaatggtcattgctaaaaatgccgcacttgataaaaacttgccacgcccaatttatatattaggtatgattgtgcacaacaaacacgtgacagatgccttcgaagaagatgggatctacacactggacggcccaaaccgcttggacattttaaagcaggttgaaagcggaacagtcattttcactgctcacggcgtttcacctgaggttcgtcaaattgcagaagaaaaaggccttgtcgccatagatgcaacctgtcccgatgtaacgaaaacacatgaactcatttcagagaaaacagccgatggatatgacattatttatatcggaaaaaaaggtcatcctgagccagagggagctgtcggagtagcccctgacaaggtgcatcttgtcgaatcagaagcggacattgaggcgctcgatttaacatcagataaattgcttatcaccaatcagacaacgatgtctcagtgggatgtccacgatctgatggagctcataaaagagaaatatcctcacgtcgagtaccaccaagaaatttgtcttgcgacacaagtacgtcaggaagctgtatctcagcaagctggccaagccgaccttaccattgttgtcggagatccaaaaagtaataactccaaccgtctggcacaagtgtcaatggagattgccggaacgcaggcttaccgtattggtgacctaagtgaactcaagctggagtggctgcaaggcgtcaaaaccgttgccattactgctggcgcttctacaccgacacctattacaaaggaagtgatccgtttcttagaaaactacgaaccggatgatgaatcaacttggaagattgaacggtcggttcctctttcgaaaatactaccgcgcgtgaaaacaaagaaataaaaaaacgtcagagcatagaagctctgacgttttttatttacataaattgaaatggatttgtgttcgattcagaaacaaagagctgtacatcatactttttatctgaacatagcgattgaagctttgcctttacgccctctttcataatcttttctgcataatgccctgggtccactacattcagcccgagcatcatggcatcatgggcgacatggaaataaagatcccctgtcacatacacatcagcacccattcttttcgcttgatgaatgtatttatttccgtctccgccaagcacagctacttttttcacaacagcgtcttgatcacctacaaagcgagcaccatttacatcgagctttgtcttcacaaatcgtgtaaagtctccaagggtcattggctctcttagctcccctatacggccaagacctttttgaataggaggaagatctgacgtgtgtacactataggcgacttcttcataaggatgtgccttgatcatttcacgaatgacttgtttttcaatacttgccgggaaaatggtttcaatccgcacttctttcacaaattccaattgaccggtctcaccaataaacggatccgcatcttctgatggcaaaaagctgcctgtcccttcatttgaaaacatacaatggctatagttgccaatatggccggcacccgcatttcctaaagccgtacggatggcttcttcaaattcctgcgggacatagagggcaagctgtttgattggatcttcatatgtcggcactagcacacttgtttcttcaagctctagagcctcagcaagcaaatcattaactcctccgtcagccacatctaaattcgtatgtgccacatatactgcaatatcgtgtttgatgcatttctcaatgatccgtccagccggctgatctgtcgctacatgttttaatggacgaaaaatcggcggatggtgagcaataatgagatccacttttcgctcgatcgcctcatctactacattctctaatacatccaaagtgatcataacattggttacttttttatttaatgtcccgatctgaagaccaattttgtcaccttccatggcatatgcctttggtgaaaattgttcaaataattggatgatttcatgtccgtttactgttttagccaacagtcaaaacctcctttagaatctttattttcacatgcagctcttcaaggcgatcgttgttctcttctgtttgcgctgcctgctggatttgactttctatcttctccatatgctgaagctcttgcatccacttgcgccggaagacgtcattttgctcttttgcaagaaacggcccaactagcatgcctgtttcaattgacatcccttcataggctttatctttgtcacctttttcggcgatgatgatttcgtatattttgccatcctcttctaaaataacttcatctatcaattcatacccctcttgatagagccataaacgaatgtgatgagcatggatatttggctgaagaatgagcctttcaaggcctgtaagcttatgcttgccgtcatttaaaatgcttgcgatgagtgctccgcccatacctgcaatcgttacagcattcacttcgcccttttcaatgacttcaaggccatttccttttctgaccgagatctggtcatctaattcaagtctatgtacttgctgcttcgctgattgaagcggaccttctgtaatttcaccagcaatcgcttttactgctttttgatgcaggatcgcataacacggcaaataggcatgatctgagccgatatcagcaaagacagcctcatgtggtaaaaagtctgcgactctttttaatcgttttgataaattcatttcattcatacgtatcactacttttctttaatgttcattcttgtctatcttatataaattaaaagtcgttttcaaatgaaaaaagctcttctgatcaaaaagagctttttgcgtaacattatttaattttggatacccattctgacatttcatcaagcttttcattcggaatcagcccgcctggcatcccattgccgccttcttgaattttcttcttgatgtctgctacttcaagcttgtcgccaacaccttttaatgcaggaccagcaccgccttcatagttttccccatgacagctaatacagttctgtttatacaattcttccggcgtcgcatttgctgtttcttcttgcttttgctcctcgcctccagaggcgattttgtcttcatctttcaaccccttcattgataagaaaaaagtgagtccaatacctaaaatggcaatcaataagaatggtataagtggattccgtttcatttctttcatcctcccctttgtgaaaacccctttaagactatacaaacaattctaattctactttaattttacaaaaagtaaacgaattatgatacaaaactttggtcaagttcacagattagacaaaaatgatgcaaagatgagaaatgaagccttcagcacattttgatgtattttttatacatcttttctctaagaacgttgcaaattcattatttattcagtaaaatataatcagattgaaaaaagcgttttcatttttgatgaagaaagaacggatctctttcaagatccgtccagtttctactctaagaagtcttttaatcgtttacttctgcttgggtgtcttaatttacgcagagctttcgcttcaatttggcggatacgctctcttgtgacgccgaacacctttccaacctcttctaacgtacgtgttcttccgtcatctagtccgaaacgtagtcttagtacattttcttcacggtccgttagtgtgtctaatacatcttcaagctgctcttttaacaattcgtatgcagcatggtcagatggagatgtcgcctcttggtcttcaataaaatcaccaaggtgcgagtcatcttcttcaccaataggtgtttctaaagatacaggctcttgcgcaattttaagaatttctctaaccttttctggcgttaaatccatgtcttcagcaatttcctctggcgttggttctctgcctaggtcttgcagaagctgtctttgaacacggatcaatttattaatggtttccaccatatgaaccgggatcctgattgttcttgcctgatcggcaatcgcacgcgtgatcgcctgtctaatccaccaagtcgcatatgttgagaatttgtatccttttcggtaatcaaacttctcaactgccttcataagacccatgtttccttcttgaatcaagtctaggaacagcataccacgaccgacgtagcgtttcgcgatgctgacaacgagacgaaggttcgcttccgctaatcttctttttgattcctcatcgccttcttcgatcttttgagcatacgtaatttcttctttagcagataacaaattgacgcgtccgatttcttttaagtacatacgaacaggatcattaattttgacacctggtggtacgcttaaatcattcaggtcaaattcttcttccgctttagccagctgctgaacatttgggtcttctgtctcttcgttttcactaatgagctctacaccctgttcgcctaagtattcatagtattcatccatttggtctgattcaatttcaaagctagacatacgctctgcaatttcttcgtatgttaaaacgccccgttttttacccgtttcagtgagcttatctctcacctgttcaaaggttagttcagtttcggtttcgtgggcttgtttatcagccattatggatccctccttccaaagcttgcaacgaattctaaagtaacttgcgatttgcttccgccctgcttttctctctttatcaaacagatgagcaaataggaataaaataaataatgatgaaggcaagatgcttgcggtcttatgctcctcccgtaaaggattcattgccagccgtaagtcttgtcataaatattagacgtattacttcagcgaacggttcaactgaataatttcttttgcaagtgttgccgctttgaagaaatctttttgcctctccgcttctgcacgttctagttctttttcctttatcattgacaaattccgatgattcaacactttctttacataatcacttaattcagcttcacttagttcgtctccaacttgaatcatgaatatatccgtcagaagctgattgatgacatcatcttctatacggttcatcaggtgctgcggcgttggttctttgccttcttcatacaaagcataaatgtacgtggccagcgccctgtgagaatctatattaaattcaatccctactctgtccagtactttgcggatcacgtcatcgctttttaccatatgagcaagcagcattcgctctgcattttcatacgctggccgcagacgctttctccgtacctgtgttgacagatgtgcacgccgtttttcaagcccgctttcttcctgcgtgcttttggcttcttgacgctgctgtttttcaaacaggtccagttgttcctttaatgaatcaagtgagatcgagaactctcctgcaagctgtttcatgtaaatctcttgttccaaggaaccgtttaaccggctaatttctcggagtacctgcttcatataagtaagccggtcaccttcatcagataaattctttcccctacggaaaaagttcatcttaaaagtcattaatgtcacacttgcatctatgatgtcattcctaaatttctcgccgccatatttacgaatgtaatcatctggatcaagtccatctggtatcatggcaacgcgaactttacatcctctttttccaagcaaatctgatgctttcatggtggcttcataaccggccgtatcagagtcatagcaaagaatgatctcttctacgttccgtctgagaagttttacgtgctcttctgttagagacgtacccattgttgcaacactttcgccgacacctgatgtgacagctgagatgacgtcagcaaatccttcgaaaagaaccgctcgttcgcgttttcgaatatgcatacgcgcgtcatgaaagtgataaagcagcttacttttatgaaaaagtggcgtttcaggactattcatatatttaggctgctgatcaccaagcgatcttccggaaaaagcgacgactgtcccatgatgatcatgaatgggaaacatcacacgatccctaaagcggtcaaaaaagcctgttccgttttcacgttgaatcaaaagaccggccttctccatcatcgcaggatcaaaccctcgtttttctaaaaacttggtcacaaaatcccaagagtcaagagcatatccgatctcaaacttggcaattgtttcatctgtaaagcctctcgcccgtaaataatcgagagcgttttgaccttcctttgtatttaccagcaaatggtggtaaaatttcttaagaagctcatgcgcttcaatcattttatgatctgcagtgtcctcttgctgtgaggagctgatctgagcatttgctacatgatcaggcaaatcaatatggtacttatcagcaacatgtgaaacggcttcaataaatgagtagccttccatttgtctgaggaacgaaaatacattacctcctgcaccacagccaaaacaatggaagatttgcttatctgctgaaacagagaatgaaggagtattttcaccatggaatggacaaagaccgaagtaatttcgaccttgctttctaagctgtacgtattctccaatcacttcgacaatgtctgcgtttttttggatttgctccaaaagttcatctggtatacgtttgctcatcctaataacactccgtcgtacattattcgccttttaattcaaaaatccttcatgattcgacaggattttttgtagttgcgcaataaatcgctttttatcctcttctaaaagctttttgggaccttttccgtatacaccttttcttcgctgtttactggaaacatgcctgcgttccaaatcaaaatcaattgtttcgttcgtgtacatccgtcctctttcagacaggacaatgacctgtcttggaagcagtaaggaggcaagaccaatgtcttgggtgacgacaatatcatgcgcggcagctgagttcgcaatgactaaatccgctgcttccttatgtgtatctacaaaccgccaatcttcaagtggagatcttttggtttgaaaatgctcatatgaagcaatgaacgtcacaggtacttgaaattgagatgcgacagaaaggatttcgtcttttacaggacaagcatctgcatcgacataaatcgtcctctcttgtttatgttcattcaggtgactaattctccatccctccaccttattcctgctttagagaagcaaaaagaccatacttttcccccatatagctaacaacagtacaactcattttgtcgaaaagttatgttcagaatcacttgacttctgccaatattagtttattcgttcttgacttaacttaaacctaaaatcaatcattttatcacaattttttattataatacaaatacagcaaatatgccattgtttttgtttacccgtttcccaccataggaaaaacccaggaggagcatcctgagtttattcggaacctcttttggtcagcatttgatgaataacatttgccgtttcttcaactgctttattcgatacatcaacaacttgacagttaatgcggtccaccactttttcaaaatactctagctcttctttaatccgttcaatgttcgcataaatggcgcgatcatttaaacctagagatttcaaacgctctttacgaatatgatttagtttgtctggactgattttcagaccgatgcatttctttggatcaactgaaaataactcctctggcggatctacttcaggaacaattggaacgttcgctaccttcagccgtttatgcgccaagtattgagatagtggtgtcttagatgtacgtgatacaccgatgagcacaatatcagcctttagaatgcctcttgggtctctgccgtcatcatacttcactgcgaactcaatggcttcaaccttcttaaaatagtcctcatctaattgacgtacacgccccggctcatgtttcgcttcatttccataagcagtctccattttgtcgatcagtggtccgatgatgtcataataaacaactccgtttgcttctgcctcttcgattaagaattggcgcatttctggcacaacaagagtaaagcagacgattccgttatctgctttcgccagtgaaatgacttctttaatcgtaccgacatcctctacatatgggattcttctaatatttgaatggtctgatgagccgccatcaaattggctaagtgccgctttgactacgagctctgccgtttctcctactgaatctgataccacaaaaattacgcgattactcataacatcccctcgcagtcttctgaaattagattatttcgttctccgataagctaacaagtattttcgtcatgtttgtttttgtaattctgccgaccacttcaaagcctttatccgtatcttttataacaggaagtgcgtctatctgcttttcaatcaagtgcttcgccacatccataatgaaatcttccttgcggcaaacggtgatgttcggcattcttgtcataatgatatggacaggaatcgatggaagctcctgttttccaatactcgcgcgaaggagatccttccttgacaacacccctgttaaaatagagtgatcgtccacaacgaataatgtgcccacatcctctaaaaacatcgtacaaatcgcatcataaactgaaacattctcatgtatcaccactggaatggattgaaaatctttcacttgaagttttttcagcttatctgctaaaagctgcgtgcctgtttttcctgtgaaaaagtagccgacccttggtcttgcttctaaaaagcctgacatcgttaatatggctaaatccggtctgagggtcgccctagttaagttcagccgatcggcgatatgctctccagtgatcggaccattctctttgacaatctgtaaaatctgctcttgccgtttatttaactcgattgtactcaccacctttaaatagagagagcgaatctttactttatgtatatcattttcataactcatcatattatagcgcatctttgtccgaatgaaacaaaaatccactcaaaaaccgtgaattaaatgagtaaaaaacgattgcccttcaaaaaaaggcaaccgttcttaggtatttattttacaattaaattgttcatattcgcaaatgattgaatgactttagctagtttcaccatttgtgccaaacgatttcgcttcagcttttcatcatctgcatgaaccattgtgtgatcgaaataatgaacaatcggtgtttttaacgtatcaagcgcctcaagcgctgcactgtattgccctgctgctacatgttcattgacagctgtctctacttgctgatacgcctcatagagcttttgctcatgctcattttcaaacagctcaggctgaatctctgcgtcttctccttttttactgattgaaatgacgcgtcctaatgcttctgctgtttctttgaagctttcttgtttcacactctcttcaagaacagctgcttttttcacaactgcatagggttcaatattttcaacatccagtactgcatcgacaacatcatgacggatatgctctgcttggaggacatattttaaacggtatgttaaaaattcaatgagagcagtttcatgtgcggcttctacttgagcaagtgccaaaagctctttgaatgaaatgttccaatgacgatcaagcagaatttgaacgataccgctcgcttgtcttcttagtccataaggatcttgagagcccgttggaatgacatcaattgagaagaaggaacaaatagaatccagcttatcggctactgccacaatcgcaccaattaaagtggaaggcgcctcatcaccggcaaagcgcggcatatagtgctcgttgatgcttttagccacttcttcatgttcaccaagtgcttttgcatatttctcgcccatgattccttgtaattctgggaattcatagaccatttgagtcacaaggtcaaacttcgaaatactggcggctcttgccacacgctctgtcgtttcgtcatctgcaccgacatgtgccgctagacgcgtcgcaatgtctgtcactctctttagcttgtcgccaattgtgccaagtttctcatggaatacaaccttatcaagcttcttaatattgtcttcaatgactagtttttcgtcttctttatagaagaaggcagcatctgataaacgcgcacgaaggactttttcgttccctcttgcgacattttcaagcgcctcactgtttccgtttctcaccgtaataaagtgaggcaataattctccttgctcatttttcacagggaaatagcgctgatgctctttcattgtggttaccaaaacttcctccggcaatgcaaggaattcttcttcaaaggaaccagatagtaccgttgggtattctacaagattgttgacctcttctagaagctcaggatcaacaggaatcacccagcctttttcagaagatagagcatttagctgctcggtaatggattgttttcttttatctgaatctgcaatgacaaattgatcgcgcaacgtttgctcataagaagcaggagagtcgatggtagttgccttaccaaggaaacggtgtcctcttgtctcacggccgcttttcaccccagcaatgtcaacaggtacaatctcctctccaaataaacaaacaatccatttaatcggacggatgtagcgtaaatctttacttccccatctcatgttctttggaaaacttaatgaagcagcgatctcacctaatgctggcagaaggtctttaacttgctttccttcttgaaacttctggacatggacataatccactcctttgatctctttaaaatagagatcatctgttgaagcaccttgtccgcgggcaaaaccttccgctgcttttgtccaattgccttccgaatcttgcgcgatttttttagccggaccttttgcttcttctttgatgtcttcttgtttttctgcgacacctttcacaagtacagcaagacgtcttggtgagttaaatagagcagcatcttcaaatgaaatgttttgcgcttcaaaccacgcttttactttttcgcctagctgctttgtgctttctggcatgaagcgagccggcatctcttctaagccgatttcgagtaatacatcttgtttattcatgagaagccgcctcctcttttagcatagggaatcccaatttttctcgttcttcataataggttttggctacttttcttgctaactgacgcactcttccgatataaccagttcgctcagtaacagaaattgcgccctttgcatcgagcaagttaaacgtatgagagcatttcagtacgtaatcgtatgctgggtgaacaagccctttgtccatttggctatgcgcttccttctcataagtcgtaaatagctcaaacagcatgtcagtattagatgtttcaaatgtataaacagagtgctcatattcagccattaagaataaatctctgaccgtaaaaccgtcagtccattcaagatcgaagacattttctttgtcctggatgtaggaagcaagacgttcaataccgtatgtgatttcaacggaaacaggcttacattctaagccgccgacttgctggaaatacgtgaattgggtgatttccattccatcaagccatacttcccagccaagtcctgcacagccaagagatgggttctcccagttgtcttcgacaaaacgaatatcatgtttcagcgggtcaataccaagcgctttcaatgattcaagatacagttcttgaatattgtcaggtgacggcttaatgattacttggaattgatgatgctgatacaatctatttgggttttctccatatctgccatcagccgggcgtcttgaaggctctacatacgctaccttccatggctctggaccaatgcttctgaggaacgtgtatggactcatcgttccggcacctttttctgtgtcatacgcctgcattaatacgcagccttcatttgaccaatgcttttgcagtgtcaaaatcatgtcttgaatattcaatgatcgcacctccatcttttctacaccatcgctatgtatggcgggtgggtctagaacctcgcaaaaaacacaaaaactcccgtctctatgctcgcaaggctccttgcaaacatagggacgagagtttttcccgcggttccaccctatttgctggtatcgtagcaaccagccgctttgttttacgttgctcaagaatgcctttcgttacgcctccatccttagctcacaccgccctaaggtcgcttttatgggttctgcgcaagtacttctttctgtcaatgcaacatattttatcttagatgatcttacaaaaagtcatggaagatgtcaacttttgttttccccgcccatgagctttttcatggattccatctgattcatgaatttttttgatttcaaataaaggcctgaatactcttcatagtagtgatcgagcacttgacgaatttcttgtttcgtctgcggtttcacatccacctgaccgagccttgataaatcaaaataatgaaataaacggagcagccttgcagctgctggggataagggcagtttatacggatctttagaaaagcaattttggcaaataaagccgttgtctctaatcgagaaatgaaactgcccttctttttgaccacagtggacacattgatccagttcgggcttcattcccatcactgataacattttgacctctacgataaataagataatatcagcatctgtgccttcattcagatgacgcagagattgaagcaggagctcaaacaaataagggtttggctttttttcttctgtgcctttatcgagtaactctgtcatatatgcggcatatgcggtcaagaataaatcctcccgaatggttcgcatactttcaatcatttcgccttgctggagcgttccaagtcctgttgatgattggatcaggaaggttccgtataaaaacggctggcttatggctgacaggcggctgtttgattttttcgcgcctcttgccatcacaccaattttcccatgttctctagtgagcagcgtgacaattttgtttgtttcgccataatctgttgttctaaggacgattccttcacttttaatgagcatttgtctacactccgagcattggagggggtcaagaattataagattggaaaatcaaatcgtgctatctcttcttcaagtacatcgggtctttccaggttctccttttctaactctttgaaaagcagatacgtgtcaacgcttcctgtttgtgaaaatacgttccatgtaaaattcaacataaaaaccccacctttctttattagaagcagcaacgctacatccaacatattaattttatcttgaccagactacctccatttcatgataaacaatttttactaatcgaaccgcaccattgtcaggttttatgacaacagcagcgattttttaatattcgtcgtctctaaatccgaagtcacgaaggtgagtggatttattacgccagtccttctgaacctttacccaaagctccagatacacttttgaaccgagaagagcttcaatatctctgcgcgctttttgtcccacttcttttaataaactgcctcgtttaccaatgacaatccctttttgtgaatcacgttctacgacaatggtcgccgccacatggatcttgccattttcatctggcttaatggattcgatcgcaactgcaatgctgtgcgggatctcttctctcgttaaatgcagcactttttcacgaattaattcagaaataataaaccgctctggatgatctgttacttgatctgctggataaaattgcgggccctcaggaagataaccttcaatctgctgaagaagcgtgtcaatgttgtttccttcaagagctgaaattggcacaatttccttaaatggataacgtgtgcggtattcatcaattaaaaggaacagctcatctggatgaatttggtcgattttattgacaactaggaataccggtgtagatgtttgcttgagtcgttcaatgatgaattcatcacccttgccatagccttcctttgcattgatcataaacaagatcaggtcgacttccttcagtgtattttgagccactttcatcataaaatcaccaagcttatgcttaggtttatgaatccctggtgtatcgataaagatcgtttgtgacgtgtttgttgttaagacaccttgcactttgtttcgtgttgtttggggcttatcactcatgatggcgatcttttgtccaatcacacgattaagaaaggttgattttcctacatttggtctaccaataattgatacaaatcctgatttgaagctttcgttagtcatttaaatcctccggtgaaaatgcgcctggcaatagttcgtttactgttgtttcgtatatttgtccttttaagttcgttagaatcactggcatgtctggtgcgcatagctctgaaataacctgtctgcatgcgccgcacggcgaaacaggccggtctgtatcagctactaccgctagcatttgaaacgatgtgatgccttctgaataggctttaaaaagtgctgttctttccgcacaattacacataccatatgctgcattttcaatgttgcagccgccatacacttttccatcattcgacaacaatgctgcaccgactttgaatttcgaatagggtacatatgcaaaatctcttgctttaactgcttctgaaatcaactcttgtttgttcattcctagttcccactttcagaagaaatggtaccactgtcacatttatattttacataattcacgtgacattttcacgcccatttctaaaaatgttaataaatagtaatattgttctattgcatgatcttcggtaagaagatgatcaacccaatcataaccgaaatcgcggcgtaaacgcaaacagcgcctgctgcggcgtctttcgctttctcagcaagcgggtgtctctcttctgtcataaggtccactgtatgttcaatggctgtattgacaagttcaagcgcaaacatccccccgcacaaaagcaatacgatcatccattcgaatggttcaatgtgaaaccaaaagccgcagatcaccacgatgatggctgcgactgtgtgaaatcgaaaattccgttcattcaagaaagttcgccatattcctctaaatgcataataaaaactccgaaaaaaacgggcaagcggccttctcttcttacgaagatcttgaaaggccataatcatccaatatctttgtctgtttggcgaacatttctttttcatcttcctctgtcatatgatcaaacccgagtaaatgaaggaacccatgaatggtgagaaatccaagttctctcataaaagaatgtccgtattcttctgcctgctcttttgtacggtccacactaatgatgatgtcaccgagtacaggcggaatatcatcagcaccaatgatttcaatttccccttctccttcttcctcaagtgcaaaggagatcacatctgtcggtgcgtcttttccgcggtattctttattaatttgatgaatctcttcatttgagacgatcgtcactgatacctccgcttgatctttgacctcaagggcatcagcagcgaattgaagaagcttttccacttcttcaagctgctcttttgttacttgtcctgtttcatctattaaatcgattaacaatgtcatttacttcaccttctgcttcggggcatctggatattcaatccgagaatggaaaatcccctttaatgttgtacaaatcgtttgactaataatatttaactctttaaatgtcagatcacattcgctgaattgcccatcctgcattttatcggaaataatgcctttgacgagcttttcgatccgctctggatttggattatgcatcgatcgtaccgctgcttccacgctgtccgctacagaaataatcgctgcttcttttgattgcggttttggtccaggataacggaattcttcttctgtcacctgatcatcacgctcttttgccttatagtaaaagaactttaacagtgacttgccgtgatgctgttcagcaatatcgacaagctcttcgggaaacttcttttctctcagcatatcagctccatctgtcgtatgggcaataatgatatttttacttagctgaggggaaagtttgtcatgcggattatcaatattcatttggttttcaataaagtattgcggccttttcgttttgccaatgtcatgataataagcgccaacccttgctaaaagaccgtttgctccgactgcttcacatgcagcatccgctaaatttgccaccatgacactatgatgatatgtacctggtgtctctgttaaaatctttttaagcagcggatgatttgggtttgatagttcaatcagcttcattgttgaaagaataccgaacatactctcaaacacaggcattaacccaatgaccaaaatagatgatgcaaaccctgacacaatcgccatcataaggtttacaccaatttcaagccctgatggtgaggagttttgaatcagcgtaatggatagaaccacaaggacattcaccaaagcgacccaaagccctgcctgcaatatttttgaacgtgcattatgctttctcaaaaataaaatgcccgccatcccgctcacaaggtaataagcgcagatcacatagttaaagacgccggttactccttgattaaacatcatactgccgcaaagagcaaatacaaggccagagaagatcgccagccgctcattgataaggagcttgatcagcatcgtgccaagtgccactggcaccacataacctattgtcgtatactttgtttcctggaagagactgaatacttccatgataactaaaataatggtaaaaatgagcgaatagagcagcaacgacttattcttatgaacaagcgattttttcctcgattcaagtgaatgaataatcgctgctaagaacagacctatcaatatcataagaccgcttacaggcttaatcaaattggagctgtttaagagccctgtcagttctaatttacgatacacttctcggtcaataagttctccttcttcgactaagatttgcccttgcttaatctgaaccggctgaatattatctgcggcttcttgtcttttcttctctgtcgccactggatcaaatacatagtttggaatgatcgcaaattcaccgatttctttcgctgcatttaagtatttggatggaattgagttattttcaagctctgttttcacttgttttttctcttcttgtaatttcgctgctgtgatttctttactcatcagtgaattcaccactgtgatgatggaatctttagtaaaagagagattttcgtcacttgcctgaagcagtgctttaatagattggtctgatacagcctcctgcatatctgatgtgagtttttctttgacacgcttgaccatttctttatctgatggtggattttctttttcatcagctgctttcttctcttctttaatggcttcaaaaagggaggagatgaggtcaacacgattgtcagaatacgcttttttgagtgtatattgatcctctacttgatctgttgcttcttgcttcttttcttctgtcgcttcttgatcatcaacggttgatggagaatagatggtctgttcgctcactgaaaacaaatctaagtcgagcgattcaggctttacatggaagaagagcaccacgaatagaatggctgctaaaccagcgtatagcaatacatttaaataacgtgagcgctccattttctgaggttcttttttagacagcagtcttttgcgcttactgtctttctgattctttctcaaggaaagtacctccttttttactttaaaccacgatcgaaacaaaatgacccgatgtagacgatcgggtcactaaggtcatttttgcttttcgtatgctccgatgatctttgccacaagggggtgtctgaccacatctgtctggtctagctcaataaatgagatgcccttgatctctgcaagcatgtcctttgcagctgcaagaccagactgcatgcccttcggcaggtcaatctgtgtaatatctcctgtaatgaccattttagagccaaacccaagtctcgtcaaaaacattttcatttgggcgggcgttgtattctgcgcttcatctaaaataacaaatgcatcatcgagtgtccgtcctctcatataggcaagaggcgctatttcaatcacaccgcgctcaattaaacgttccgtatgatcactgccaagcacatcatgcaaggcatcatatagtggtcttaaataaggatctactttttcctttagatcacctggtaaaaaaccaagactttctcctgcttcaacagctggtcttgtcaagataattcgtttcacatgtccatttttcagtgcatgtaccgcgttgacgactgccaaatacgttttccctgttccagctggtccaattccaaagaccaagtcatcttttttcatcgccgcagcatattcccgctggccaatggtttttaccctgattgactttcctttagcatttttcgtaatttcatcttcatacatattttcaaaataattgagcttgtctttttgcgccattttgatggcatatacgacatcccgttcagaaatctcaattccttttcggatgagatgtaagagagatgtcatcagacggctcgctgtttctcttgatgcttcctgaccagaaacatacactttttctccgcgcgtaataatggagacattcagctcgttttccatcagtttcagataagcatcttgatttccaaataaagcaatcgcttcgtttgggctatctaatttttgttgaatttcaagtaaatgttctgtcattctctagtctccctgaacaataggtgttggttgaacaatatcttctattacttggtaaaggatgattaacttaactttaccattccctgttgtctcgtgcaaaactttttcacttttcacctctcctgtttgacctagcttctcttctaattcttttttacccattttaatccctgcttgaaccgcttctttatttgtgtatgtccggttaattttttcactttcgcgtgtcgtttctttttcataggaaaatgggagctggaactgtaagaaatggagtgggtgaacttctgtttcgatttttggctgcttaaaatcatcctttttaaaggaaaagccccaaaatggcattgaacctccaaatgcggagagcttgtgctttgtcttcattttacccgtaaagacatcaaaagatgttcgaagagggacagaaacttcagaacggtaccacgtttctccataaattttcgctttagcaccgaccgttttttgcttgtcttcactgccgatgaggcctgagacgagcatttgtcctttcttcacatgttcatcaactgcggcaagcggctcccctttttctacatacattcttgtgatgaccgccttcttcttagccacaatatgctgaggactcgtatatttctctttctcaggctcatttttttccacaactttcatttgaaatgttgtaccgtttagttcaacgccaacccatgtaatgctttgaatattggcggtcagtgatttttgaattttttcaggtgttcccattagaaactgaaaacggcctttttgcaccccaatctcgtctaaatgctttctcatctgatgttcagtttctggattggctcctttaatatctattttccacaccatgtttgaaagcgccaatatcgtcactagaaaaaacacaatcccaaaggtaaacccaatattctttcttgaccataggagaaggaatggaaatcccttcctttgatgaaatgaacatgttacctcatgatgtctttgtacttttctgaaggcatgtacatctgataagcgaataaataagcgcacgctgtcttgacggcggctcacttgaaacattgtgatcccctgtctcgtgcactcattgatgagccgctcaatgccgcttcccttgatctccacttccactctgccaataaaataggcaaaccatttattcttcacacttctcccctccgtcagttaagaatcaatataacggacctcatcgattttcccttctaataagatctcttctggcaaaatcgttttaatcacaaaatctttccctgaaataatgcattgtccttgtttgagcatcagccttacctcttgatcactgaaaagcaaaagccctttatggttctctatgtaaatgtggagtctaccaaccatcgtaatacggggaagatccatcatgacgtctggagggatttcaagtgttcttgtcagccatgctttaagtcgattttttctttttcccattcaataagaaccccttcccacctcatgtgtatgagatcaaactgaaagatggtgagactgatgagaaagcctctatgtcatcttattcctcagcggttcagatcatgctaatgaatcccgcaaaacagccatttcatcatttttcactgcgagaggtctccctcaagtcaaataaaaaaagcccctttttatataaagggactttcttgtttatctgttatatggccgtttcatcgttctgtgcggctttttcgcgcgcggctctccaaatacttctccaagaagcatgccttgaacaacagtattttgattaagcttgccaatgatgtgcggcttcatctccgcagcagaagctttcggcttggtcagctgcctttcaagagattggaactctttattcagctcactttttctttcttccatttcagctagtgtagcggtataacgatcctgtaaggactgtgatccttgcttcttcatcccgccatgatcatgtacatcgccgaaatcgtccaactggtctgttttgaccgggtttgggctcgtttgttctgctttcttttgagacataggcttattctgaggagccggcttatgttgccggttgttttgttccttctcctcttgtttgccgatttttccaaatacagcagagataataccgatgataatcgcaattagtaacggattttcaaatagaatgtccattgggctccctccttaaagcgtgagaggatgcttatttgttttcattatcagatggaccttttgtcattttaccaaatgaatctctcatgtccgtatcagcatcgatattcttaatgttcatgtagtccatgactccaatattaccttcacgtaatgcttcagccatggcaagtggtacttcagcctctgcttctacgactttcgcgcgcatttcttcaactcttgcacgcatttcttgctcctgggcaacagccattgcgcggcgttcttctgcttttgcctgtgcaatgtttttatctgcttctgcttggtctgtttgcagaattgccccgatgttcttaccgatatccacatctgcgatatcaatcgagagaatttcaaacgcagtacctgaatctaatcctttaccaagaaccgtttgagaaatcatatctgggttttctagaacctttttatgattatttgatgaaccaattgtagagacaattccttcacctacacgagcaatgattgtttcttcccctgcaccaccgacaagtcgttcgatgtttgcacgaactgtaatacgtgcttttgcttttacttcaatcccgtccattgccacaccagagataaatggtgtttcaatgactttagggtttacactcatttgtacagcttcaagtacgtcacggcctgctaggtcgatcgctgcacagcgtgcaaagttcaattcgatattcgcacgttgggccgcgatcaatgcatttacaacacggtcaacgttaccacctgcaaggtagtgactttctaattggttaatcgtcacatcaagacctgctttatgtgctttgatgagcggattgaccactcggtttggaataacgcggcgaagtctcattcctacaagtgtaaaaatgctcactcttacgccagccgctagggcagaaatccacagcatcaccggtacaaaggtgaagaagatcgatagaacgatcagacctgctgcgataatcacaaataatagtaaagtagatggatccattttattcctcctataaaatcagttatctatactttcctcacgacaatgcgtgagccttccgctttcacaatttttactttttcatccttatcgatgaatgcaccttctgacacaacatcaatgcgttcatctccaaatacaattgtacctgacggacgaagtgcggttgctgtcaccgcgatttgcccaacaagatcttctcttgtttcatttgagacataaccgctttccttattggttgaatcggttaaaatgaactttttgaaaaatttcatacgtttccccaacacctttgtcaatataataactgctatgattgaaacagcagtggcaatcaagatggaaatcgccatttctgtaaagcttccagctgctaaaaataagctgacaaccacacagatcagtccaatgacacctacgattccccccggcaaaaacaattccaggatcaagagcaataaccctgctaaaaacaggaacaacgtctcataacctgcaaaacctgccacaagatgaccataaaagaatagaagaagcgctgtcactcccatggtacctggaaccccaaagccgggtgaatagagctcaacgattaaccctaagcttgcgatggataaaaggattggaatgacaattgggtgcgtgaaaaagcgcgcaaccttttcagcaatgctcacttcatcgtattgaatagaagcgtcttctaaattcagcttctgaagcaagtcatccatatttttcgcttccccttctgcataaccgaattgaagcgcacggtctgtattgaaggtaagcaattctccttttggtgcaccagcttcttttgcgtctatatttacatctgccattgcaagtgcatactttggatcacgcccctgcttttcggcagcgtcactcatttcagcaagccatagcgattcagatttttgatcggcagcattgccttcaccgtcaatgatcgcagcagcccccatctttccatttggggtcatatagatttggtcggcatttagcgcaaggaaagcccctgctgaaagcgctctatgattcacaaacgctgtcacagggatatcagacgcacgaatggtatctgcgatctcaagcgccgcatcgactgccccacctggtgtattgatgtctagaatgatatgtttcgctcgttcggactttgcctgctcaaatgatcgctcaataaattgagaaagtcctttttctactgtatcttcaattgggataacatgaactttctgatctgctgatttcgcggtcaattgaacccctaataataagcatattataaaacagctgaagagagcaatagaaatttttatttttttcatctatttggtgatccctcctctctatcttccattttaccgttcctttacatacgttacaaatgtatcataggtttcatttttatatgacagattgatgagggtataaaaaaagtacccttctaacaatagaaggatacttttttattgagacagctgctcgctgacaaatctgttaatgacagctccatcagctttaccttttacttttggcataatagcgctcataactttacccatatcagccttcgatgaagcgcctgtttcagcgatcgtctctttcacgatcgtttgcagttcttcttcagaaaactgttcaggtaaataaacgtctaagatgtcaatctctttttgaactttatctactaaatctaagcgattagctttcgaaaattcatggagggagtctttacgttgcttaatctcgcgggaaaggacggttagttcctcatcgccggtcaaactgtctttcttaagcttaattgcttcattttggagtgaagcctttaccatccgaatgacaacaagcttgtctttctcacggtttttcataaaaagcttcatatcagaatttaattgctcaagaagactcataaaatccaccctctttagaatttacgttttctagcagcttcagactttttcttgcgctttacgctaggcttttcataaaattcacgctttcttgcttcttgcaatgttccagttttggatacactgcgtttaaagcgacgaagagcatcttcaagcgattcgttttttctaacgaccgtttttgacattctctttccctccctccgaatacaccaatcgactgcattaaaaaaagatatacatgcgaaacatgtacctagatattataatataagcctagtgtgaggtcaactaagtgatttggaaatatattttcgtcatgagcaggtagacaagtccatatattcattggtaagaggaggacttttctatgatggcgatcatttatttttgtgcacttattttcatttttttatggtcaatgggtttgctgagaaaaggattaatggcgcttgcgtcgtctcgtattgagaaatcacttcttctctttacagatcacccagttaaagcattcttagtcagcattatatttacagggattctccaaagcagttcggcgtttatggtcatcgtgatcggctttgtcagtacaggcattctctcttttaaaaaatccattccaatgattcttggtaccaatattggctccacgtttacaacagaatttatcgccattaaaatggatgttttcatgtgggtcttgatcctagctggcctcatatgcataatgttaggcagaaaatcttttcggcatgcaggaaaaagtatatttggactcgggatgatctttttttgtattcaaggcttttctaaaattgcaggtatgatgacaagtcagcctgagacattgcgctttctcgaaatgatgcagcattctgactggacggcgctgctttcgggtactattttcacagcaattgttcattccagctccgtctgtatcggcattttaatgggctttatgaatgaaggaacggttgggcttcaggaaggcatcagctttgtgttaggatccaatatcgggacatgtattacagccgttatggctgccatatctggcggctatgcagcacgtcaaacggcttatgcccacgttttgtttaatgtgctcggagtacttttatgtctcccatttctcgccatgatgacagaatttgtcgcccttcttgcaaacgctccagctcagcaaattgcgcacttcagcctgctgtttaatgtggcaagctctttgcttttcttcccattcatccgtccatttcacacattgattttatgtcttttaccgaatcaatcaaaataaaacaccggcttacccttttggcagccggtgttttattgatcatgaggtcattctcactttgtttgtttgtacttcatcgcttatacgaacgaattgtccttcgttataaggataacccgctttcgtgattttcactttgaccaaacggccgatcatgtcctctgttccttcaaaaacaaccttcatatagttatctgtatagcccacataaagattttgctttccttcttgttctttgaaggattcttccggaataatctctaggacatctccttcataagctgatgcgtattctttcgcaagctggtcagaaagagcgatcaagcggtggacacgttcgttttttacattttcatccacttgatcatccattcttgcagctggcgtacccgtacgtttactgtaagggaatacgtgcagttcagagaattgatggtctttgacaaaattgtatgtttccaaaaactcttcttctgtttctccagggaatcctacaatcacatcagaggtgacagcaagacctggcaatgcttttttcagctttgttaaacgctctgcaaagaattccatcgtatatttacggcgcattcttttcagcactgtattagagccagattgaagcgggatatgaagatgtctgacaatcttatctgactgatcaagcacttctatcacttcatctgtaatttgacttgcttcgatagatgaaatacgaattcgttttaagccattgacacgtgcatctaattctttcagaagctttgcaaagttataatcttttaagtcttctccgtatccgcctgtgtgaatacctgttaatacaatttctttatagccggcatccacaagctgctgcgcttggttgatgacctcttctggatcacgagaacgaagaagtccgcgagcccaaggaataatgcagaatgtacagaaattgttacagccttcttggatttttaatgacgcacgtgttctgtctgtaaaagcaggaacatcaagttcttcaaacacacgtgccttcatgatattgccaaccccattaatcggctgtctttctctgcgatattcttcaatgtaaccgagcaatttatgtctgtcttgtgttcccacgacaatatcaacaccaggaatcgccatgatttctgctggagatgtttgcgcataacagcctgttacacaaatgacaccatccgggttatgacgaatggctctcctaatgacttgacggctttttttatcgcctgtattcgtgaccgtacatgtattaatgacatatacgtctgcttttgattcgtactcttttctttcatagcctgcttctttaaacaactgccagatcgcttctgtttcatagtgattgaccttacagccaagtgtatggaacgctactgttcccatcatgattcacctcttaataactctgtttgataagatatagcagaaagcgcgtaaagaggagctgtttccgttcttaaaatgcgtggtccgagcccgcaaatgactgcaccaagcgtttcaagcgctttaatctccttttctgccaaaccgccttcagggccaaaaaccactagcaaggtttgtccgcctttcatctgttggagcacagtttgaaagcggctttgctctccttctttcgatgattcttcgtatgcaacgacacatttatcgaattcaccagctaattgagtcagctctttaaacgttgatactggataaacatgaggaatgatattccggtaggactgctcagctgcttctttcgcaattttctcccagcgttctcgttttttatgtgacttcttttggtcaagttttgtaatagaacgagccgcttgaaacgggataaatgaacttgcgccaagctctgtgcctttttggataatcaactcaagcttatctccttttgggagtccgctcgcaattgttacccttaccggaagctctctgtcctgatttgtccagccttcaaggtgacaaatgacttcttcctttgttattgtatcaattttactgagcgcttcaaagccgtctgtcgttaagcaaaggatttcctgccctgctttcatgcgcatgacgttggaaaggtgatgtacatcttcacctttgatgacgatagatccctttgcgatcacttcttctttcgtgaggtcgataaaatatcgttgcatacgtgtcctgacacctactcgctttattttttcgctataatgctgacccaatcttccattgacagcacttcaactatgtcaaaacctgcttcttctaatgctgttttgacttgtaatttcttttgtccaatgatgcccgatgtaatgaaatagccatctttcttcaataaatcataagcttgatctgtaaagcgcaaaatcacttctgcgagaatgttggcgacgatcacatcacgttcacctgaaatcccatcaagtaagttattttgcttgaccgtcacttgttcgcttacaccatttagctcgatgttttgcttcgcactttcaaccgcaacggtgtcgagatcaaaggcttgaatgtcctttgcaccaaccatcgctgctgccacacttaaaatcccagagcctgttccaacatcaatcaccgtatcgttttccttcacatagcgctcaagcgcctgaatacacagaacggttgttggatgtgtccctgttccaaatgccattcctgggtccatttcaataatcagttcatcagaatgaaccggagtatattcttcccatgttggaacgatggtgaatttttcagagattttcacagggtgatagtatttcttccatgcggtggcccattcttcttcatttacttcacagatagacagcgtatttcttcctaggtcaatatcgtatagaagaagattgttgatggcttctttgatctcatctaccgtttccattaaaaagctgttcattggaagataggctttgacgatgaccccttcttcaggatagtcattcggatcgagctggtagatctcaccgtatacattttcacgttccttgactaaatcaagcgggtcctcaatcacgacaccactcgcacctgcttcatgcaaaatattggtgattggttccaccgcttcatttgttgtatggacgctaatttctgaccacttcaatactaccaactccttatccgtcttactcgcctttaaatgcgcgttttaccttatcgaagaagctcatttcttgttcgtccggtttatttccgctcacttcagcaaattttctaataatatctttttgattgtccgttaaatttgttggtgtgacgactcgtacaacgatatgctgatcgccttgaccatatccgcgtacatttttcacaccttttcctttgagtctaaatttcgtgccagtttgcgtgccagcagggactttcaattttactttaccgtgtaatgtcggcacttcaatttcgtcacctaatgcagcctgtgcaaaggttagcggcatttcgcagtaaatgtcatctccgtcacgctcgaagaattcatgcgagcgcacatggaacacaacaaataaatcgcctggaggtcctccatttacacctggctccccttgaccagacactctgagctgctgaccatcgtcaacaccagctgggatcgtcacattgattttcttacgcttacgcactttaccagagccgccgcatgtagaacatttgtgatcgatttgttttcctgttccgctacagtagttacatactctgcggttgaccactttaccaaacggagttgactgctcaacatttaattgaccagagccgccgcaatgtgaacaagtcttcgcatctgttccaggctttgcccctgatccatgacacgtttcacatgattcctcacgaggaatttcaatcgttgcttcttttccaaatgctgcttcttcaaatgaaagcgtcattgtatattgcaagtctgctccttgacgcggtgcatttggatctcttcttctggctccgccgccaaaaatactagagaagatgtcatcaaagccgccgaagccgccaaagtctcctcctccgccaaaaccgccgccgccaaagccttggtttggatccgtatgaccgaactgatcatactgcgaacgtttttgatcgtcagaaagggtttcataggcttcttttacttctttgaatttctcatctgagccagcttctttattaatatcagggtgatacttttttgaaagcttgcggtatgcctttttgatctcgtcttttgaggcgctcttactcacgccaagcacttcatagtaatcacgcttactcatctcttcacactcccgattttctcacataaatacgattgtatcattttgatttgacctttttcaattgctttcatcgttggaaagaaaaaaagtcaaagccaagagatcctgactttgactttctgacgagtacgtttcagcagtctttttcaaaagtaaaggtgattattttttctcttgatcgtcgtttacttcttcgtattctgcatccactacattgtcatctgctttttgagcaccttcagcgccgccttcttgctgagcttgtgcttgctttgcagcttcttcatagagctttgtcgttagttcttgaacgattgtttgcagctcatcttttttcgctttgatgtcttcaagctcgcctttttcgatcgcagcttttagtgcatctttcgcgtcgtttgcttttttcacttgctcttcatcgattttgccttctagatcttttaatgttttttcagttgtaaacactaattgatctgcttcattgcgcacttcgatttcttcttttttcttcgcatctgcttcagcattttcttctgcttctttgaccattttttcgatctcatcatcagaaagacctgaagaagatttgattgtgatgttttgctctttgcctgtacccatatctttcgcacgtacgttgacaataccgtttttatcaatatcaaaagatacttcgatttgtggtacgccgcgtggtgctggcggaatgtcagtcaattggaaacgacctaatgttttgttatctgctgccattgggcgctcaccttgcaggacatggatgtctaccgctgtttggttgtcagcagccgttgagaatacttgagatttacttgttggaattgttgtattacgttcaatcagctttgtgaatacgccgcccattgtttcaattcctaaagaaagtggtgttacgtcaagaagaacaacgtctttgacatctcctgtgatgactccaccttggatcgccgcaccaagagcaaccacttcatcagggtttacacctttatgaggctctttgcctgtttcttttttgattgcttcttgtactgcaggaatacgagttgatccaccaacaaggatgactttatcaatctcgctagcagataaaccagcatctttcaaagattgacgtacaggtgtcattgtacgctctacaaggtctgcagaaagctcttcgaatttagcacgcgttagcgttaattctaggtgaagaggacctgcatctccagctgtgataaatggcagtgagatttgtgtagaagatacaccagaaagatcttttttcgctttttcagcagcatcttttaaacgctgaagcgccattttatcttttgaaaggtcaatgccattttcttttttgaattcagccactaagtgatcaatgatcacttggtcaaaatcgtctccacctagacggttgtccccagcagttgagcgtacttcaaagacgccgtctccaagctcaaggactgatacgtcaaatgtaccgccgccaaggtcgtatacaagaatcgtttgatcttcatctgttttatctaaaccataagcaagtgcagctgctgttggttcgttgatgatacgttctacttcaagaccagcaattttaccagcatcttttgtagcttgacgttctgcatcgttgaagtaagcaggaactgtgataacagcttttgttacttcttcgccaaggtaaccttcagcgtaagatttaagatgttgaagaatgattgcagagatttcctgcggcgtgtagttcttgccttcaacttctactttataatctgtacccatatgtcttttaacagacatgattgtgttcgggtttgtaattgattggcgtttcgctacttcaccaacttggcgctctccatttttaaaagcgacaacagatggtgttgtacgtgctccttcagcgtttgcaatgacttttggctctccgccttcaagtactgcaacacatgagtttgttgttcctaagtcaatcccaatgattttactcataatcgatgacctcccattatgtagttattgatttacttttaccattgatggacgaataactcggtctttgagtttatagcccttttgcaattcttctactacgatatttgaatcgaagttttcatcttcaacttgcatgacggcttgatgaaggttcggatcgaactctttgccgacagcttcaattggttcaacgccttcatttttcaacgcttctaccagctggcggtaaaccatttgcattccttctaacaaacttttcgcctgctcattgtctggatcaattccaagcgctctttcaaagttgtcaagagctgggagaagatcgctgacaacatgttgagaacgatatttttgcacggtctccacttcagttcgagcacggcgtttatagttttcaaaatctgcttgaacacgcagaatcttgttttctttttcatctagaagctgctgcaattcatcgattttctcttggaaggcagactgttcatcctgtgttacttcctcagtatctgcttgaactgcttcttcttgtgcttcaacctctgcttcttgctcaggtgtctgtttttcttctgacattgtgttcacctccctcaaaagattcaagaatacgaaggggctgtgcccctgccttttatcaccctactcatcatacaaattggaaagtgcgtttgacaagtcttttgatacatgatgcaaaagactaacgactcgcccgtaatccatgcgggttggtccgatgacggcaatggagccgagtgatttttgatcaatcgaataagtcgctgtgatcagactgcagttctccattgcttccaaattgttttctgaaccgattttaatggtgataccttgctgatttggatgaaacagctgcatgacatcattcttttgctcaatcagcatcatgagtgagcgaatgcggtcgatgtcatgaaattcaggctgattcaacatattaatcttcccgccaaagaaaagttttgattcattttgtgtcgatgtaaatgtgttaccaagcgcatctaaaatgtgatcataatcttttaaatgtgtgcgcagaagcatgaccacttctttatacatcctgtccttcaactgatccattggtacgccagctaagcggctattcaaaatattcatcagcttctcaatatcggagacatcgagatgctcagagaaggtaatggttttgttttcaacatgtccgctgtctgtaatcatgatcgctactgctttgtttggctgaacggggacaagctgaatttgctttaatcgattttcactcaactttggaccaagcacgatcgatgtatagtttgtgagatctgataaaatttccgccgatttttgaactgttttttccagctcaaaaattttctcctgaaaagccgactggataagcacaagctctttagacgacagttttcgcggagagagcaaatgatctacataataacgatatcctttttctgaaggaattcttcctgatgaagaatgggtcttttcgataaaaccaagttcctccaaatcagccatttcgtttctaatcgtcgcagagctgaatgtgatgtcctcttttttagaaagagtccttgacccaactggctgcgccgaacgaataaagtcattaatgatgacttgcagaatcaaaagctgacgatttgttaacatcatcatcacccctgttagcactctctttcaacgagtgctaattgtataaacaaaattaccaaactcaaattaaaatgtcaattataactcaccgagaaacgcttgaaatacttcatttcctaacaattttccttttcttgttaaacgaattccaatgtcatcttttacaatgagacctttttctgctaattcttcaagaaccgtgggaaaaagagcttctggtgaagcaccatatttggcttggaagtcggcacttttcaccccttcgatttttcgaaggcctaaaaacaattcttcttctatctgctctgcttttgtgacttgatgagtttctttatacgggaacccagtttgctctatcagttccaagtaatgcttcactggtcctgcgttcacatttcggatgccatctacatacccgtgtgcccctgcaccgaaaccgaagtagtcttcattgctccaataggtgaggttatgctggctttcaaaaccaggtttggcgtaattactgatttcgtattgatgtaatccatggcgctccatttcatccatcacaagctcatacatttcagcctcccgttcttgcggcggtaaatgcagttttcctttttgcattaagttgtaaaacaccgttttcggctccacaatcagtgagtagacagaataatgctctgctcctaaagagaaagctgtctcaagtgaattcatcacatgatgcttttcttgatgcggcaagccaaacatgaggtcaaggctaatgttgtcaaatccaacatctcttgctcgctcgaaagatgtgagaacatctttcttttgatgaactcgtccgatttttttgagcaaatcatcttcaaaggtttggacgccaaagcttaaccgattgacaccggcttcttttaacacatgcagcttctcgagtgataattcatctgggttcgcttccactgcaaattcaaccaagttttttgacggttttaacacacggtggatgctggtcatgagctggtctagctggctgacggtcaatgatgtcggagtccccccgccaataaagatcgtctttagttcttgctcacccttttgctcgatcgtgtgctgcatctctttttcaagagccgctaagtattcatcgactggctgcgttttaatgaaaaatttattgaaatcacaatagtggcaaatgtgctcacaaaatggaatgtgaatgtatgctgctttcatttgatgacaccttctttacaggtaaagagccgcagtttatcgctgcggcacctttgtttgttttcgactataaacgccaaggctgacattgtaaagcaggttgccttgaggaggatgttattttttcggtgtgctgtcgtccatcttcagcacagccataaatgcttcttgcgggacttcaacagagcccacttgtttcatgcgctttttcccttctttttgcttctcaagaagctttcttttccgggaaatgtctcccccataacatttagcaagtacgtttttacgcatcgctttaatggtagagcgagccacgattttttgtccaatcgctgcttgaactggtacttcaaaatgctggcgcggaataagttctttcagcttttctacgatgatcttgcctcgttcataggcgtaatcgcggtgaacaataaaggaaagagcatcgattttttcgccattcagcatgatgtccattttcactagagtagatgggcgatagccaatcagctcatagtcaaaggacgcatagccttttgtgttggacttgagcatatcaaagaattcatacacgatctctgccaaaggaatttcgtacacaatgctcactcggtttgcatcaaggtattgcatatcaatgaaatgtccgcgcttcccttggcaaagctccatgacagaacctacataatcattcggtaccatcattgttgccttcacgtatggttcttcaattttctcaatcttttgcggatcaggcagattggacgggttatcgacgatgattttttcaccgtctgtcatatacacatcgtaaataacacttggtgctgtcgtaatgagatcgattttaaattcacgttcaatccgttcttggatgatttccatatgaagcattccaagaaagccgcagcggaaaccgaagccaagtgcttgggacgtctctgcctcatattgaagtgaagaatcatttaattcaagcttttctagcgcttcacgtaaatcgttatatttcgctgtgtcaattggataaagaccgcagtaaaccattgggtttagctttctgtatcctggcagtgcttctttcgctgggttcaccgcacttgtgatcgtatcccccacacgtgtatcgccgacgtttttaatcgctgctgttaagtagccaacatctccaacagtgagttcatctgtcggcatggcttttggtgtgaatacgccgacttcaagtacttcaaattctttgcccgtcgccatcattttgattttctgacctggtttgacggtcccttccacaattcgtatgtacgcaataacgccgcgatacgcatcgtagagagaatcaaatataagagcttgaagcggtgcttctgggtctccagcaggtgctggcaccttttcgacgatttgttctaaaatatcttcgatcccaatacccgccttagcagaggtgagaacagcttcagatgcatccaacccgatgacatcttcaatttctcctcttacacgctcaggctctgcacttggcagatcgattttattgataatcggaagaatttctaagttgttatcaagagctaaataaacgttcgcaagtgtctgtgcttcaattccttgtgctgcatctactacgagaatcgcaccttcacaggcagcaaggcttcgagatacctcataggtgaagtcgacatgccctggtgtatcaatcaggtgcataatatattcttctccatccttcgccttatatttcagctggacagagtttaatttaatcgttatgccgcgttcacgctctaagtccatggaatcaagtaattgttctttcatttctcgctgcgtaatcgccgctgttttttctaaaatacggtcggccaatgtggatttcccgtggtcaatatgggcgataatggagaaatttcgaattcttgattgccgttctaatcgtttttctttatctgtcacaatctatcactcctactataaaacgcgggttgcgctaggttagattatatcaatagggctgtaaagattcaatcgaaatcaagaaaagccgctcatcaattagcggctttagtcatatggtgttgaattgtttatttcccattcacccaatcataaagagaacgagctgcatgtgtcatgccatcagacaacgccttccctgccttggagaaggcattaaagctctctatttcctcaagctgcttttgtttttcggcaagatccttttctgtaacagccgttcctaagatagaggcttctcgttcttcatcatcgttcatttggatggagaaagcgccttttaattgcgggtcatggtaacccttcatttgcagcatgccattatttgcctgctgcattcctaaaaagacgccaaatagcaagaccagtcctaaaataatggtttttccaataaatgaccccatgcaccgtcaccaccttaagagcgttttgtctcatcctttgctttgccgtttaccttttccgcgtcccagaaaatgtcgctgaagacatcagctgctgcattggatgcatttttcaattcttccatattattatccactccgccaaattctaaaagaagggctttgtcggataaatcttgattataaattccattatcaccaatttcgcctttggcaaacacaccgacactgagccctttatattttttctccatcaaatggtggaactccgtcgcaagcttgaggtttttctcatagctttgattcttcttccccacaacaaacgcaattctcgcatatttctttcctttgatctcgacagtggtgtctttctttcttcttgagtcacggtggatatcgattaaatattcgagatcatcatttttcgctaaggcttcttttacgaccagtcttgattcattataagactggggatactttagtcctttttgcagaagccgtttttcaacttctgttttgtcgaccgtattcccgattccttgctgatcaagcgcctttccgaacatgtcgccgacaagggtgacattcactttagagtgccgtgcattgtttggattcgtttctccttttaaaaatggtaaatatgattccgtattatgtgtgtggtaaatgtacactgcttttcgttttcctgtcgaccggtccggctctttcgcaggctttttcggcacatctttgtcgagcttgtccagctctgccaaattcgcttctttttcatcttggatgacttcacttggcggcggcgattccattggcatgttggtataatctgtgccttcacccgctaaaatgatttttgtatcaaaatgttcaaagcccggtagttctctccctagaaaactacgcgggtcttctaaattgatactggtcgcaagcttgagtgacagtccagagaaatgaaaccctttttgatctttcgggacggctgaggcgaaatattggttttccatgcccattaatgtggcaaaaaaagccccggaaagctcatctgctacaccatatagcgaggcttgtggcctcagctccggctttaaagatgtcagcgcccctgacatcacaaatactacaacaagcgaggctataaataagaaaatgcttttgactactttcgttccattaatcgcaacgaccaactgtcgaggacggcggggtctttttttcatgatttactccctccagcacgctttctagtaattacactatgagcgagctagagaaagtagaaccgattaatgattataagaccccttgttatcttgagagattttttgatgaagcgctgtgttcaatccattggcgagcacgtttgccatatcatcaatgaatgtatccacttccttaggcgtgaccattaaattttgccctagcggcgcaagcacttcatggatcagctgccgtttctcttcttctggaagagttcctacgatacctaagaatgattgacgcgtttcctcatctggtaagtcttcttcgtttagtacttttttcttcccaaacgtcaaaccagccggcacaagagagcgggacggccggtcatctttcagttctctaccaaaatgctttaagacataatcaattgtgtcacttgcaatggtgactgcatctacgactgtcggaacgccaatcgcaatcactggaattcccaacgtttctttgcttaattcttttcgcttattccctacacctgaaccgggatggatgcctgtatcagagatttgaatcgtcgtattcacccgttccactgcacgagcagcaagggcatcgattgcaatgacaaaatcgggtttggacctctcgatgacaccttgaattatgtcgcttgtttcaataccggtcagtcccatcactcccggtgataaagaggacactgggcggtagccttcctgtacattttccggctgcaattcaaaaagatgccgggtcacaagcagactttcaaccgtgagcggacctagcgcatctggcgtgacattccagtttcctagacctactacaagacagctcgcatcagtttgtatgcctcggtcttttaaaaactgagcaaaatgatgggcaaagacttcgacaactttttcctgcatctcagaatctttctcccgaatgccctgcgcctcaagtgtcaagtatgttcctgcctttttgctggtcagcgcctccccttctttcgtgatctccaccgtgcgtatacggatgccgtgctcctctttttccttttcgacaatcccttgaattccgtcctttttgacgacattcggatcgttctcttgttctagtatctcttttgtttcaacagccaggtctgtccgaatttgataagcacttaaatcaagtttctgtttctccataaaaagactccttccaccaagtaattaacagtagtctttccatctcttgaaagaaacattcgagcgcttcatcaatgaaaaatactttacatttatattgcattctaaaggtgtgtttgatagaatacaacttgttctattgtgaagatttaaccttaagacaattgtgtttaggttgtatcttaggaggtgaaacacatgccaaatattaaatcagcgatcaaacgtacaaaaacgaataacgaacgccgtgcacacaacgtgacaatcaagtctgcgatgcgtactgcgattaaacaagttgaagtttctgtagctaacaacgatgctgagcaagcaaaagctgctctttcttctgctgcaaaacgcattgacaaagccgttaaaactggtcttgtacacaaaaacgcagctgcgcgttacaagtcaagacttgctaaacaagtaaacggactttctgcataatgcttgcaacgcctcagtaatgaggcaactgtttaactgtacgtccgtcctgaccggctcagccattaggacagactggcaattatacatctacaaaaacgaccttctttttagaaggtcgtttttgtatgttcaagcgcctaataggcgaagcagaaacaattctagcaatagctgcttgtcctttttaccggttttcatttcataatcgatcgttgacagctctttgacaatctgcttgagctcttcttctgtaaacagtcttgcctgatccatagcaagtttgacgcggaatgggtgaacttttagatttgaagcaatttgtttttgcccatatccttgctgagcgaaatattttgtctgcaaaatcaaacgaaattgagtggatataagcgctaatattttaatgggttcctcattttgtttcagcaaatcataaaacatctgcatggcctgagagcggcgtctgttgacaatttggttaattaattcaaaaatattctgctctaagcttcttgcaacaagctgattaacatccgctaattcaatttcttctcgttctccaatatatgtactgagtttcctgacctcttgaaacaatgaggataggctccctccgcacagcatcacaagctgctcagccgcttcagaggaaatcgactttccttctgttttcaccagtgtaatggtgaaatccgttgtttcttttgggtttaactcttttgcctcaaccatagccgctttcttttttagcaatttggtgattttctttcgttcatccagcttttcatatggtgccaataagacgagaatggtataaggcgccggcttttctaaatacgcttctaacagagaaagctcatgctcaatcttctcctttttcttttccgctgtaagaaaataagggttcttaatcacaacaagacgcctttctcccatgaacggaaaggtttctgcatctgtcacagcctgttcaagcggtacctcttccatatcaaagacggagtaattaaaatcctttgtctcctcgtctactacagtttgtcttaatttagctgctgtttcttgcagtaaatacgtttcttttccatataagcaataaacgggatggatatcccctctttttaaattgttccaaacctcaaagaccataaattgaatccctctctttcacttcctcctctatcctaaagtgtgcgaagacattagtaaagaggaagctgaaagtaccgcctcctcatttatagtaaacgtctggtgcaagctcccgggtcagcttgccacagacgatattcataaaatgatcatgaaaatggaaaacggttactttaccttctagcaattccaaatgagttcaagtatactaaaattagccaggagggatgaaaatgaatgaatttgaaaaaaatgttcaaagcaagcggaatgatgtgaccgactcagccgttggttttatcgtcacattcggatttttcgcctcaatgtttattttggccaccattatacacctcgttggatcttaacttcatgaatgctacatgactgccgttttggcagtttttttattgattttgtaagatatcatatggaggatgcgtgtaaaacgttcctttctcctcaagaaattcatatgtgacactcccgtctcgatctgtacggtacaccttcgtttgatgatccatgagttttttcaagacatcctgatgaggatgctgataacgattgcgttcaccagccgaaatgagtgcatgcgacggctctagatgccgaagccactcctcacttgttgaccctttgctcccatgatgcccaacctttaagatatctgctcgcaggtgagggtaggcttccataatgtctcgttccccttcatgttcaagatctccagtgaacagaaaccgtttcccgccaagagtaaaagctagaacaagtgaatcattgttcttacttgtcacccggtgttgcgaagggtggagaacctcaaatgtgtgctctccaacttggagctgatctcctctttctaattcaacaatcataatccctttttcagcggcttcttttaacagttttgcatcctctggacttcgggcaaaaccttttggtatagccagccgctttactttatttcgcttgattaaatgaaccgcttctcccatgtggtcttgatctgcatgcgtgagaatcaacacatcaagttttgctataccttttgaatggaaaaacgggattagcgtttgatcaccgatcgtagatactttacgtctttttttccatggttcatcatcaaaagaaagtctgccacctgtgtccacaagtagatgtccctttcggtaagggagctgaataaacaaactatccccttgtccgacatccagcatcgtgacctctcctttttggagaaaattcggggtgaaatagtgtgcactcaagacaccaatgagtaacagaatcggcacggcataggatttaacggacattttgcactccatcataaatagcagaaaaacaatagcactcatttcaagcagaatatgccaccaagtcgatttcataaaaattaagttgaacccatcaaaaactgccatatgtgctgacaactgatgacttagctggatgaccgaatcaagcagctggaacaacgctagcccaagcggaagataaatgatagacaaaagaaaaaagagtaaggacagaggcaggacaactgtcgtataaaaaggcacaaatatcatattcaatgggatgctcagcaaagaaaatagctgaaaatgatataaaagaacaggaagcgaggcaagctgtgccacaaatgagatcaggaataactgcatcactgcgcttttcgcttgtgataagattctggtcgataacaaaataaaaaacgtcaccacgaatgaaagctgaaatccgatatcgaatagatatagaggatgaatcgctaataagaataaaaacgctgcgcttaatacgacagcagaagactgtttcatttcttttggcaggcttgtcatcactaaatagattcctgccataaggcaagctcttaaaactgatggtgcagcacctgtcaaacaagcataaactggaagaaagcataatagaagaagacgcgctgtctctctagtcacaccggcacgaagcagacaccaaaataaacaggcaagaagcgtttgcacatggagtcctgagatcgctaacagatgaataatgccgagcatttgatagtctcttagtgtgtcagaatctatcaattctcgttctccaaaaataagagcctgtacaatacctacagagtttttcggtacatgatcttctaagaatcttaagcccttttgcctcaccttttgaagaaaataggaaggacgatcattttttgtacagcctttgattgactgcggtaagaaaatagcgcgaatgccttttgattttagaaattgatcgtattgaaacccgttaggaatggttgcgtgtttaggtcgtcgaacatcacccatcatatgacagctcatacctggctctatatcttttagcgcctctttttcacgctctgtttgaatggtatagaaagcggctagccgctcatcttctgttgacacagtcgccgaaaaacgattgccatctgttttcggaatcgtttcaatcacaacggagccggaaaagaatttttcttgaacaggttgatctttttcaaaagactcatgaaccataaaaataagaatatagacagctccacataggctgatcataagaaagagtttgggaatttttttcagtagactgagaaggaagatgatgagaagaaagagaaggaaatacatatgaagatgatatgcagccagagcaattccaacagctgctgaaattgccccaaacggcaaataattaaacatacgaagtaaataattgattcgccttctcatgcatatcgcgaatttctgattcactaagtcctgattcacttagtttgccaattagatctgcaacaaaggctaatttttcttgattttttaagtcgatgatcatttcatcaagttcaacttgttccgtttgaacacctgcctgctcaaataaatcaatggcgtatgggtgatttttataatcctttgcatagtatacggttcgaatacctgcttgaataatggctttacagcactgcaaacaaggaaaatgtgtgacatatatttcagcatcggatgtaggtgcaccaaatttggcacattgtaaaatagcattcatttccgcatggatggtgcgaacgcagtgatgatcaatgacatagcatcccacatctgcacaatggacatcaccagcaattgaaccattatatcctcccgcaatgatacgcttgtctctgacgatggtcgccccaacagctaaccgctcacaggtgcttcgtaaagcaagcaaatggctttgtgccataaaatattgattccatgaaattctttccacgagctgatccctccagaatgatggttggtattaagtgtacatgccttccttctataccgtcaattctacttaacggtcaattcatttttcagccgttcaatggtcttctccccaaaacctgaaatgttccgcaaatcttcaatttgttgaaattctccgtgttcctctctgtacgtaatgatggcttctgctttagctggccctattccattaatggtttgcaattccgccgcatcagcctgattcacattgacaccttgactcttttcattacctgatggaacgcttgcacctactgtttgtgtctctctctctgcttctccctgcttccggacataaatcatcatactgtcttctaattttgctgcttgattaatttcaatcgtgtctgctttactagtaaagcctcctgcccttcgaatggcttcttctacccgcgcatcaggctgaaacgtataaacacctggcttttttacagcccctttgacctccacaaaaatggaggatgattcattatcggtcttttcttgtttgtcttctaatgtgacttgtttgtcttgatcgcccttcaatacacttggctctctagtgccccccttatttcctaccaaaaggaagaaagtgatgatgatcgcgcccatgagcccagctccgatataaagactgtattttttcaatggaatgaatcgcttcaagtgctcacgcttctttcaatcatatttttctattgctcaacatactgtttagaagataacagatcctatgcgcctaaggagggagaacgtttgaatatcgggataatcggtacaggaaacatgggtaccatacttactgaggcatttattgaatcaaaggcagtcaatccctcatccatcaccattacaaaccggaccattgaaaaagcgttcaatataaaaaagaaccatccagagcttgaagttacgaaacagcttacaggagctatcacgaataaagattttatctttgtttgtgtcaaaccgcttgatatttatcctctgttaaaggaagtgagccctctcttaacagagcagcaaaccattgtcatcatcacaagtccggttcatcctgagcagcttcaggatgtcgttccttgtcaaacagccaggctgattccaagcattacgaaccgcgctttatcaggagcgtcacttttaacatttggatcgtcatgtaatgtcacaacgaaaacagcgttaagacaattagcttcctgcatttcaacacctatcgaaattcatcattcgattacaagagcggcgtcagatatcgtcagctgcggtcctgcctttatcagcttcctcgttcagaaaatgattgaagcagccgttgaagaaacggatatttctaaagaagaagccacctccttatcagaagatatgcttgtagggcttggccgtttgatcgaaaaaagagtctatacccttccgacactgcaagacaaagtgtgtgtaaaaggcggcgtcactggtgaagggattaaagcacttgaagcaggtgttcaagatatgtttcaccgcctttttcaaaacacacatgaaaaatttgatgaagatcttgaagcagttgcgcatcaatacccgccaagtgtgtttactgatgatcacagaaattaatcaactctgcaacaagcgaaaaaaggattttaaaaaaccatcgttccattaaacgatggtttttggtttcttagctgaaatgaaatatctttcggcgaattccccgggcgcttcatttgtaaaatcagcagtcacgtctatttgttcaaagccagcggactcaaggaacgccgcatacgtctcaaatggaaatgtacgctgttcatgtgtctcatcataacgctgatacacgtctccgtcctttacaaaaaagcttaaatcgtgaatgaccgaatacatgtcatcccctttatcactctgccaaatatagctgatctcttcatcttgatcggcataagtcgaacctgggaataccttatccattttgtaaggagtatgaacatcaaagagtaaaaccccatctgcctctaaaagctgaaacatgtttttaaaggtttttttgacatcattttcgttttttaagtaattcaaggaatcacagcatataaccgccgcttgaaagacttgctcaaaacccgtcagctctctcatatcttgatgtaaaaattgaatggactgctttttcgcctgtgctttttgctgcgcgaaagccagcatttcttcactgaggtcaattcctgtgactacatgacccttttcagctaaccgaagagaaatctctccagttccacagccaacatcaataatggcagcattcggtttgatattctgctggatccactgaacccattcatcataaggtgcatgtgtcatgagctcgtcatatacacctgcaaacccttgataaatcatgagttaatgccaagtgaaagcgtttctctcggcgcatctccccatagcttctctaggttgtagtatcctctttcttctttgtggaacacatgagctatgacatcaccaagatcaatcaatacccatcttgcttcatcaaagccctccatcttcttcacttcaattccactttcctctgcaagatgttttacctctcttgcaatggcctgaacttgtttatcagagttcccgtgacaaatgagaaaataatcggcaacaagtgagattccttgcatattaagggcaataatatcctccgcccgtttatcatcgcatgctcctgccgcaacgtttaaaattgatgatgaatccatccaaattcctccttaattgttcttaagcacaagtgagttgtaagtcgcaagcgtatctggatagactggctggttctttttcaataaaaagctgatcgtgttttttagtgactgaatcagtgcgctatctagatctttctctgccaactctcttacttcttcaacaccagggaaatgacgtcctggttcgatataatcagcgacataaatgaccttttcaagtaatgtcatgtttggtctgcctgatgtatgaaattcaatagccgttaaaatgtcttggtcgtgaatagctacttcctttttaaccaaataggctccgaccggggcatgccaaagctcgggcgaatattccagcaatagagggttcatctgctccttttggataatccccttcatttcatcctttggtctaaatttcgcataatcatgaaaaatagcggcggtttctgcttttttcacatctgcaccgaaccgttccgctaatgaaatagctgtctccataaccccgagtgtatgtgtatatctatgctctgttaactgctctttgacacagttcaatgcttcttcacgattcatataagtgatgctcctttatataacgctcaacaggtttcggtatcaaataatcgacaggtttttcctgcatgattcgctgcctaatcaatgtcgatgatacatcaaaagctggaacatctgcaaataaaagaggatatgtcgtatttccggtataacccggtcttttcatcccaataaaagtaatcatctgaagcaaatcatcaatccgatgccattttggcaaatactcgaccatgtccgctccaatcataaaaaagaactcatcttcaggatgacgcttctttaaaagctccaccgtatctactgtataagatggaccctctcgctccatttcaatgagctccaatcgaaaatgtggatttgactggatcgccgcttccaccattttcacccggtgacgactatctgctcgtttccggtctgttttatgaggaggcttgtgatttgggataaaccaaatttcatcaagtcctacttgaaaacgcacctcatttgccatcagtaaatgcccattatgaggaggatcaaacgtaccgccgaacaaccctatttttttcatatcacatccacctttacggcagcttaatttgtttattttccttcgattctttataaaggacaatcacatttccgatcgtttgaacaagttcagcttttgcacctttgacaagtgctttcgcaacttccgttttgtcctcgtcgcagttttgtaatacgctgacctttaacagttctcttacttcaagcgcctcggaaatttgcttgatcatattgtcatttaccccgccttttcctacttgaaaaataggtgataaatgatgtgcttttgcacgtaaaaaacgtttttgtttcccttttaacatggtgttcctcctaatttctgtatcacaattgacttcatttttcttacgtcaggcgtgatgcctgtccatagttcaaaggctctagctgcttgtccaacaaacatgccgacaccatctactgttttcaaacctaacccggctgcttctctgagcagttttgtttctattggattatacacaatatcacaaacgaccgctgttttttttgcgtttgctaaagaaatcggggtttcttcaacattcgggtgcataccaatagaggttgtatggatgatgacatcatattccccaagctgctcttccgccgtctttaatgtaatggcactagaactgatgttcccatctgcactttcaattaaagcctcagctttttcaatggtgcggttggtgatatcaaagcttttcggtgcatagtgagcaattgtcgtataaattgctcttgccgctcctccagcaccaattagaagaaatgaaagctctgataatggctgatccaaggcttcaagcaatgaatgaagaaagccctctccatctgtgttgtacccaacgagctgacctccttcgagccgcaccgtattgacggcacgcaggcgttcagctgtgacatcaattttgtccaggtactgcatgatgtctaccttgtgcggaacagtgacgttaaagccgctgattcctaaggctttcataccgctaatcgcatctttcaggtcatcattttctacttgaaagccgtgataatgtccatcaattccagcatcctttaatgctgcattatgaatatccggagacattgaatggccaacagggttaccgattactccgtataaaggtttcaaggtctctccccctctgaacaattatattaacgaacgtctcataaacacatgcacgccttttggcgcatagactttaatttgcttacctgcatcatttgccgtgatccatcctaagcctgagaaaacgatatccattttgggctgatcaatggtaaaggtatgcggaacgagtgctggaaaatctcccatcccctcttttgatggcggtgatagcagttcccctgcatgtttttcatataaatcatctgcgttctctaactttgttctgtgtatgttcagctcatttggcatatagcagacaaatgacgttctgccgccttttacataatcaaatcgagcaagtccgccaaaataaagcgtttgtgcttcatttaattggaacgttctcggtttcaattcttttttcggcgttaagatcttcaagtcatttttactgacatagtgcgccatctgatgacgattgataatgcccggcgtatcaaatagagcagatccatcatcaagcgggatctcaatggcatcaagtgttgtacccggatattgtgatgtggtgatcacgttctcttcgccagatacttctttgatgattcgattgataaatgtagatttcccaacattcgtacagccgacgacatagacatttcttccctcgcgataatgatcgatcgcttccatcacctcaggtacgccctgacctctgcttgcactgattaagaacacatcgatcggattcaatccgttttctttcgcttcccgtttcatccaatgaatcaaacgatcttttttcacggatttcggtagaatatctactttgttgccgacgagtaaaatcgggttaccaccgacaatacgactcagcccatttatccagcttccgttaaagtcaaaaatatcaacgaccttgacaatcagagaatctgtctctccgatgctgtgcaatatatttaaaaagtcgtcttccgttaaagaaacatcttgtatttcattgtagttctttaacctaaaacagcgctgacagatcacatcttctttcaatagagatgctgccggcgcatatcctaattgatctttatcttccgtctgaatggctacaccgcagccaatacaaacaaccttttccattattactcttcctcccactgaatgtggcccttacgctttaaggctcctaaaattctgcgttcaatctgcctgttaaatttagtgaaaaatccgtctgaggcagcaacagggacgaccaatatcgtatggaagccgtgacgattcccgcctagaacatcggtcataagctgatccccaatgaccaccacatcttcttttttcaattgcatatcagcgacggccttattaaaagctcttcccatcggctttttcgctttataaataaacgggatatgaacgggttcagaaaaaagcttgacccttttttcattattgttcgatacaatcgtcacttgtatcccgtgatccttcatttcttgaaaccattcaattaagcggggcgtcgcacttggacgatcccattctactagtgtgttatctaaatcggtaataattccttttacatttcgttcttttagtttttgcggtgaaatgtggaaaatgcttttcacaaattcatccggtaagaaatacttctttagcacaatttgcaccctttcttccattggtttttcagcgattgtgtcgaatcaaatcacaatttgtctgtctatcgaatacaatgaaaaagttttcgacatatgatgaggaccttcaacaggtgtggataattttacacacattatccacctatattccatcacgctttcattcaattataaacactctacccacaagttatccacttcaccatgtggataacagaacgattgttcttgtttcccattcatggtagattaaaggtacttcagagacattcgatcaacctatgatgatatgtcttttcctcaagttttatgccaactttttcaggggaggtgtttttcccatcatatgggtttctagtatgaaaaagctgtcagatgatttacttatagaatcgtactataaagcaaatgaaatgaacttaaatcgcgacttcattgaattaattgagacagaaatgaaaagacgttcgctcgggcatatgctctctgtttcctcttaattccatatcacaggaaccatgcctcccgagcactctccttttttaaactcaggtgactgatattatatcacttgcgctataggcttactactattttccgtaaaaaacaccccttcttaacaaagaagaggtgtcttatttgcaaggctgttcattccaaaaccataaccctccacctacgaccaaaatgaccacaaggaacacaacaagaaaagcgtaaccgattcctgctccttgagctggataaggcgaacacgcagggtaaggataagggcatccccacatatcagttacctccttctaggaagatatactgttagactatgctggatggatggtcttgtttaggcagatggccatcatttaaaaatgtttaatgacatcccgctctttgatttcgttataaatgattcttgccccttttggcgtcatatgattgccagaagggtcgatcaaacctgattgaatcagcgcattgtcactatcttcgcccgcttctcggatgaacgctttccagttgtcgacaagcggtacttgctgatccttggctagttctctcgtgatgtcattataggaattttgccaagctcttgccccgcctctctcagcaaaataagatgacttatacctagagtaataatacaagcccttttttccgccttctacaacaggaacgcacgtcatgagaattggggtaatacctgcttttctactttcagaaatgaagtaggttatattttctttaaatctttttttcgtcactcggggatgtttcccgtctaaaatcgccgcatcattcgtaccgaacatgatgaggacgtaagttggtttctgctttaaaatatcctgctcaaagcgaagcttcgcatcttcagtcgtctgcccgccaatccctgcgttcttcacttgaatttgaccgcgctcgacgtttttcatgagattcacccatttttcagatgttggataatctcgaaagtcccagtttgatccctttgtattgctgtcgccaaatgcaatgacactttcttgttctggctttgaacacccagcagcgacacaaagcaggatgaaaaggacaacatatttcttcacaacattcacctccaaaagccctcttcatatagtaaacgacaagacttttggtttcaatgaatgactgtttttgacgaatacttcctagtgcagttgaacaggtacatacgatttgtcatgatgcagcagttcgctcactttgacaaattcatagcctcgatcctttaattcaggtatcacttgtttcagtgcttcgaccgtctgcttccgatttcccccgccatcatgcaaaagaatgatatcgccgccttgaatgtgatcaataatccggctcgcaattttgcgtgagcctggtcttgaccagtccttcggatcttgcgtaaaggaccacatgaccacatcatatccttgttttgacaaaatgcggaaagatttcatcgtcaagcggccgccaggagggcgaaatattaagggccctcctggctggagtgaagcgatatgagccgctgattcttttagctcctgcttgatctcctttgatgataacaggtcaaaatacgtatgattcatcgtgtggttgccaagctcatttccctcgcccacgattcgtttcgcaatctctggatatgtatgaatccggctgcctatagcaaaaaagctggcattcacttgatgctccttcagcacatctaatacttgattcgtgtacactggatgaggtccatcatcaaaggtcagtgcaatcttttttcgttcctgtctcatgtcccaaaaagctcgtcctgttttttctaggtcgattctttttaatgttcgagcttctattttattaggaacaaacgtgcatagcattaatatacacatcaagacatgcaaccctctcatttgaccgcctccacagaacattcttacagattaaattgcccgctttttaatgaatcattcaacattcaaggtcacgatccgcatctctggcttcttttttacataaaaaaagctggccatcaggcccgctttttgtttcacgtttggtttctctcttcaactgtcgaacgttgcttagaattcatacagacactctccttcttggatttgattttgagcccataataatttgcgataatactggttggacttctggtattgttgagaggcttctaaggctgtcgcaatttctagtgagatatcctctatataagagtataggctaagtttttccaaataatcaatggttttttgcagttgttcttcattcatttcttgaacatataaagcatctagatactcaaacatatgacagaacagctggtcttcatgcttctttgcagctaattttccatcctctaatatgcggcatgctgctacttgttcattttgtctaaaaagcagttttgccagcgtatagagcgtatgcggaagcgtgggaagctgctctttacaggcaatatcagccgattctgttaaatagcgttctgcttcctcaaggtagcccagctccccataacatttccctaaattataaagcgctgaactgtatatccgcgggtgatcaatttgtgatgcgagctgttttgccttttttaaatgaggcagtgctcggtcttttcgttttaaatcttgatagtttcctgagatcacaaacaggcactgaatgatgcgaatagaataagcatcatgctgatcgtatatttctagcgcctttaaaatatgatgcatcgagacatgcgtttgcttcataatatagtaggcttctgctactttaaaatgaaattcagcctgctcaatatcatcaaataccatagacagctgtttttctgccactcggtaatatttgacagcttctaaatattctttttgactaaactcatgcatgccacgaaaaaatgcatggtaataatgcagcatatcagataactcatgattggagttttcgattttatcgacaagattagatactgagaaaggttgatattttgaagggtgtatatagtcaagcatgatctggtgccgaaaacacatgagctgataataaatcagtaaatgctggtcctcttccatccgttcaatttccgcttctacttctgcttttaggatttccgcatctggaacactgaactgccgtatcattcgataccattcattaattttcatacctacatgtgaagaaagaaccttccccatgttccgaaaaaaccccttccttttcggtctaatattacatattttagcacgcttcttgaccgccaagcaccgcaaagaaaccgcaaacatatgagaagggaagcaaaacaagacgaacagaagcccgtttttttcgaaaaagatgattttttcatcgtacagacacagacaatccccccttcacatacatttgaggatataggcagtggcctaaacatggtggaggtgaaaatcgtggcaggagtatttacagcgatgggattgatggtcaaagaattggtgttcttagtgtcctatgtcaaaaacaatgcctttccacagcccctttcgggagatgatgaaaaaaaatacttagcccttatggcagagggcgatgaacacgcgagaaatatgctgattgaacataaccttcggctcgtcgcccatattgtcaagaaatttgaaaataccggggaagacgcagaagacctcatctccatcgggacgatcggactcattaaagccatcgaaagctattcctctggaaaaggaacaaagctggcaacgtatgccgcgcggtgtattgaaaatgaaatcctgatgcatttacgcgcgctcaaaaagacaaaaaaggatgtctccttgcatgaccccattggtcaggataaagaaggcaatgaaatttctttaattgatgtcttaaaatccgaaaatgaagatgtgattgatacgattcagctcaacatggagcttgaaaaagtaaaagagtatatcgacattctcgacggccgggaaaaagaagtgatcgttggccggttcggccttgatttaaagaaagaaaaaacgcagcgggaaatagccaaggagctcgggatatcgcgaagttatgtgtcccggattgagaagcgagcgctgatgaagatgtttcatgagttttaccgggcggagaaggagaaacggaagcgggagaaggggaagtgaggagaaaaagttatcttctttttaattattgactaactgtatttttctcacttcaataaattagaaattcatactactctggatatgatttttccgtgtccagttagctgttttgcttaaatttttaatgcagcgagagaaaacatcgctgcattaaaattattttattaatcatctaaatttttccaaataaaacctgtattaccattacatttcacgtagttattccaactaagtttaagaacataaaatatcaacaagaaacgcttagcttttttcttagataaataagatttatagtgtaaataaaaattcaatcagatctactaattctgaataatcaatctatattcctagataattcttttaaaattaaagtataactttctattttatgtttaaaagaatcaatacctccctctagatagtttataattaatttagtaattttcttatctgtaggaaaacccttcttttcaatccacccatgttcgttgtctgattttaaaacaataacctgttcagtatcggcatttgtaacaatagtagaattatgagttacaactattacctgtcggttatttttaatttgccttaaactttccacaagatttttataaatatattgattatcaaggttgtcctcaggttgatcaataattaatggtgtattatcattagtaaaataaccataattaaaaacaaaagaaagtattgcagctactttttgacctaaagatatttcatttatatctttcattaatggtttttgatttatagaagactccttcatatttatattaaaatggattgtaaaatcatcgaatacttcaaacaactttttaatacttgtttctaaaagctctcttcgaattaacaattcgtgacgtattgtttcaaaaatgatggtgctatattcatcattaatttcaattaaatccgcatcaatatctttaaaatctttattatttactactattgacgaaagttccaacatattctctaactctttataatttgaattaaataatagatcaagaaattttagaaacccttctttctttgaaaactgataaatgtagtttgctacgtcactccaagtgagtctaatttgttgatttacgtattcaccactgctgataacatctaaaagttcctttagatattcatctatattattaattttaggagaatatataattttaagaaaagagctaaattcaaaattaaactctttaagcatttcatcaattctatcttttctctttctcatttctataatgataatttttaatttctcttggagtattttttgtgggttctttctcttatcacttaacttatatataaagctttgtatttcatcatctttgaaattactaagtattgtacctttaatgaagtcgccaacttctcccctttctatttcatttacaatattatttatagaataccctcgatgataggccctacttaatatttcttgaatgtctgcgtacttaactttttcaaaattaacatcattttgcttatataaatttatccaattttaggtaagtttaactttgtttttcccattcgatctatctaatatataagagctttgtagaaagggatcatctatataatattcctcctctttattttttacttgaggaataaattcaagaacataattatatccttctaaataaaaagcaatatatattctttcatgtttagatatcattttgagcttttcaaaatcatctatttcaagacaaaaggcacattcaatcatgttaagtaaagtactttttcctgcccctctacctcctataatacaatttaaatctctagaaaaatcaacaacaaatggattttcatttgtattcaaactacttcttaaaaagccttccttgccagggtatactaacacccccataataaacttgtcagatttttcaggtttttcttcatagacattaattctgtgattactaacagcctttttcagagaggaaaaatccatattactaaactttatccatgtatttttaactcctagagtatcaatagcatgagaatcgccttcatatattattccaaatttcccccttgcctttttgttataacaacttattttatcatataccctatctttagcatttaattgagtaagaccaaaaacatttagtttatctgaattaaaaagagtgctgttatatgttgaactaccaagaaaatctgaggaatttaaatgagccaaataaataatagcatctaattttagttttgaaatttgttcaattacattctgactagtgtaatatgttcctccctcttgtgacattatgatgtcattaagaaaggacttaactttttctatatttttttcatcaaatattgttattaaatgatttttttctgaacaagaaatttctacccctaaaaataaacaaatagatttttttgagtgtttttttcccttaattttttctgcaaaatattcctctaaagcgtactttaattttgtataaccactcacagtgttatggtcagaaacaactgcaacttctatatttttttgatatagattatgtgctattaactgataggctaagtactctttaaagctagaatacggtatgtttttctcttgtaattgttctctataagaatcacttatatagtggtttatattccctaaaatctcctcttttatttcatcatttatgtacccagttactaatgcaacattaattatttcttcctctgtcatttctttatataaataatttttatacagtttataatcataagaagctggggtatggatatgaaattcacaccttttcaaggtcccatatcttactctttggtttctaattttttgatatactctagtaatataactaaaatctctttctgacaaaggaatcctacctccaatatttaattacagttccaattacattaatagtgttctaaaaaaagtattcatatcaatacgtctagtacaattgttaagtaatacttgcaattatactgagacaacttaatatttgcaatgacttccatacagagaaaattctagaattttctctgtatttgaatgcttgtcatcatataaactatgcattctttcattttagacacacttcaatcttgcccctaacttttcatacactcctgaaaatcaatatccctcaactcaacccattcaacaagatcaggcaccttttttgtcgtcaaaaaatggtgaacgatttgataagcttgattccgatcgacatagctacacgacggcacatacaatggggcacctgcgaccaaatgctcgatcgtttcaattttttctccctttttaaaaggaaccaaaaaatttgggtacctcatgatcaagaaaccatacggttccgtataaaagaaaactagactttcactttcccaatcttcttctatctcaatggaagattctccgttaccttgttcccaatactcttcaccctcctgaaagaaaattcttttcatgaattcttctcccggatttgctactggagctcctgtggggccgtagtataaaaacatctatatctctccttcatacctatatcaacttgttaaccaactgttctatttccttcaaattgataaaaagcttgtggttcttcgtttaatttcagcaagtgatatagctttgggtttagcttttgaaaagtttgcttgctgacccattttacttcttcaatatcatgatccggatcgagaatactcatttgacctccggtgatttcagcaaagaaggtgatcatcagtgcatgatgctttttgtcttgaaagaatgcttctcgaaccgaatgaagttcatttactttgcaaatataccctgtctcttcttccacctcacggatcacggcttgatgcagttgttcgcctttttctacagcaccaccaggaagtccccaatatccctttacgtttttgaccattaaaatattttctgcctcatcattcataatagctgatactacgtctactcttttcaaatgaatccccctcaatcattctcttttctcaacaattatccaataaatagcacgaactgttcatttcaatacattcattatacggtatccttgatacaagagaatggataagaaagcaaacagctttcgtgaacagattggaggccacagcatgtggatcatcatcattttacttattgtcctcattgggtttacagggaatatcgtttctttattaagacaaatgaaagaatcaaacgagaaaattatacaactgttagaacagcaaaaaccgaaaaaataaaaacctcactcttttagagagaggttttttagagtaagccattattcttaccgtttctcatgaaacaacatatatctgattcgacgaatataatgcagcgcaatatgaacgagacataaaatgagcccgatcatcgcaagaatataaatgggcagcatcaaaccaggtacatagttgacgataaaacccaaacaaaacgctgtcagcatatataggctgatcaacctcattaataccattcgaagccctccctttctacaactttaacatcatttcctttattttcataattggatttaaaaaaatgcgaatccactaagattcgcatgatcattacgtattcaattcacctttcttcgcccgcacttccttccactgctcaagctctgacactgtcaataattgatatccttgtttggttaattccttgataatcgtgacagctgcgtttgccgaggtgtcgtagatgtcgtgcattaagacggtttctccgctagacgcatgtgtgagaatgtagttggcaacgtactggctgttgcgatatttccagtcttcaggatctacatcccaaagcgtaactttcatgttgacagccgagttgatcttcccgtttgttccaccatatggcggtctaaagtgagtcggtgtgaatccgcccgctttttcaatgatttgctgggtctcttccacttgtttgatggcttgttttaatggcagtcttgtgagtaaaggatggctataggaatgatttccgatttcattcccaccctttctgatttcacctagcatatcagggtaatattgaaccctgtttcctaatacaaaaaatgtcgcatgtcctctattttcttttaaggcttttaaaatttttgaggtcgtggatggatttggtccatcatcaaatgtcagggcaatagctttttgactcgggttgaatgttgcttgttttggcagtttgacgagctttctttttgagatcggttcttttttctcatttttgttcttttctttatgaatgtattcgggctttaacagtcctttaagcagcgtttttttaatcgccagcacttgaggtccttgttcgcttggtgcgatttgccctgctggaaagtagaattctataaaacgatctttgatggcaaaatactgataatgctctgctgcaggagacgttccttgtttgagcaaatgctcattttcagcaagagagcgatctttttttaattcatcaaatgtcatttgagacagtttttgcagatcttctttctttgataaaaatagatcatctattgataaaaaatgctgtttcttgaaatcaaaattgaatatctttgattcatgttcgccctttactccgccttttaattcataagtattgaatttgatcgcagcggtttgcttggcataatgagtaatctcgtaatctatgtttaattcgtatcgatgatcttcatcgacatcgtttgcttcactgaatgatgttttgaatttatctagcgctgtttcagcaaatcttttcatctcttgatctagcttttcttgatgaaagaccggatagttgacagcatatctcatgtatctcccgtcattcacgagggtgactatttccacttctttatagctcgcatcttgttctactttcttcttctccgtcccgcttgcctgctgattatgataaaacgcagcaattccgatgatgattgcaagtccgcataggacgagactaatcttccatttcattgacacaataattcccctctcgtgatggcgtcatgccttgatgacgtgtgtttgtaggatagactttgcgtgaaccccatttagttttcaaaaaacaaactcgtcacattttagacacattttaaaagaggaatagaaaaagggcttgatttctcagccctaacattatttttgcatatatagttgaaataatttcgtttcttcatcaatcgaactcgctcgatcaaaagccgctctaagcgtctttgtattgttcaatcgctcataaagcatagtcaatacaaagatgaatgccgcattcccatcaatgtaatcatccggcgctacataggacatggcacctgcttctaaaaaggcatctgctagttttttctcacctagtgtgcagcctgtagaaataacgtgaaccccttctaacgaagcatatcgcttgatttcatccactccaaaagcagcgcctctaggctccccatcttcatatacatcttcccctaattccggcatgagaaatgctccttcttccccatgaaacgatagaagaatataatcgatttctcctctattttttccagataacacattgatcaggtcatttggtcttccgatccattgcatatcgactttcacaccaaagttttcaagtgctgcacgcagcgcaaaagattccagctcactatttggtcctgctgctaacataatgcgcatcgtctgttgatccacttttatcccctccagattatgataaaaataaaaccattttttcctcatctgcatatgtatgatcaggccattttagtgctttttcttcaagtgcgtatgactcaaatccaatagagcgatacaggcgtttggctgagtgattggtcgtcacgactgataaatacatttgctcaatgtcatgtctttctccggcgaatgaaagaacttctgtcatcaaggccttgcctactccttttccgcgggcacccgccgttacatacatcgctgctacattcgctcggtgctttaatttctgcaaattttcttggatgagcgtgaccatgcccacaagcttcccttgatcaaaggcaccaaaggtccacatcaattgtacagaagcaaaacgagctgcgtatttttctattgtaccgatttgctcttcttcataactcatcgcaaagccctcaggatgtaatcgcagtgcttctagtctcaatgcggcatattcttcagcatcatctggtgttaacaatcgaatattcagaacatcgcccccaacagaatgattaatacgtccaattttatcttgaaaggagattttgatcaaaatgtttctcctgaaaataaaaaggcatcccctaaaaggatgccccctccattaccacttacagcgtttcactggacggcagcaagggtttttgatatcactgccgcaatcgtattctttcacgatatactcgttatgagtcgactcagtgacaggatagtagttttcaattcttttgatgtttttgttgacgtttgtgatatgcgttggatgaatttttctgatggtttgttcattcgttcttgtgttgacaatttgacgtgtggggaaaacaaccgtttcatctcctccatggtttcctctgcgaggtccaaagaaaaaatcatctaatcgattccggctcatctcaacaccccttcaatttgtctttcacttacactctatcgtatgtaagagacgccattcgtgattagatgcttgtctattttttaaaaattccgctattcatctcgttttctctctctttacaaaagggtgattttaacatattatacaaatgatatattgtgctagaagaaagtgccccatagccttcccactcatcatcaaacacgaggtgaacgatatgatcaatacgacacaaccaatcgaacgaaacaagctagacattgcacttgaactgactcaaatgcatttgaatcaatatgaaatgaatcatcctgatcagttgagtgaggtttatgcgaaatattatgcactgcttgaagtgctggatttatcttcttatgatcaattgattgatttattgccagatgagctaaaacagacgcttgagtaaaaaaccctctatccacatgggatagagggttttctttatactcgtgctgccatatcggtttcgatttgttctaggcttcttccttttgtttccactagtacaaagcgggtgaacaatagtccgattaagcagatgacaccaaatgaggagaaaatgaccccgaagctgaatttgtctgccaagatagggaacacgagtccaacggctaacgatcccgtccagttaaaggcagatgaaatacctgcgccgatacctctgacagaaagcgggaaaatttcgccgatgatgatccacgtgatcggtgcccatgagaaggcatagcacaagataaagcagcaaagtgaaattaaggtcacccagtttaaaatcccttcactaacgccaagcgcacctaatgcggctggtgcaaagaaagaaagggccatgcccgttccccctacggtgagaatcgttcggcggtcgaaccggtcgacaaattgtaaaaagatcacggtggtgacgacaaaaatgacaccgacaatgacggtaaaacctgcggcaacctgaggtgcaagccctacattccgagcaatactcgttgcataatacacaatagagttcgccccttgaatttgctgaagggtcgccatcccaaccccgatgaaaagagccattctaaatttcttttggaacaactcgcgaataccagagcgttcttcttttgcgacttctaaaatttcctgcatctctgcttcgatttcctcatgagaagagcgcagtgatcctaatacttcccgtgctttatgagccattccgtgtttaattaaatatctcggagattcaggaagcttcagcataccaatataaagcacgatggcaaataaagcggcactaccgagcatccagcgccagctgtctggaataggttcaaacacaaatgcgacaatatagctcagcaatagtccgctcacgatcatgagctgattgagcccagacaatttcccgcgaattttagcaggagcaatttcagacatgtatgccggcaccaaagatgaggctgtaccaacggctgttcctaaaaagatacgtgcaatggttaatgaaatctcttctggtgcgatagctgatccgatcgctccgacaaaaaagataacagatgagaccaaaataagctttctgcggccaaatttatcccctaagagaccgcttaaaatggagccgatgatcgccccgcccattaatgaagaaacgacaattccaagccataatggactgagctgaaattcttgctgaatatgcccttctgcccctgcaataatcccaatatcatatccgaataagatgcctgcaaaggacccgaaaaagaagataaatttgcttgacacttttttctccaagtggatgaccccctcacttaattaaccgctttcatttcatcccgtgcttctactgtaatcagtagaagacctttcacccttctataaaaccacatattctgcactcacaagctttgcaaaatgaacaatttgatcaaccgttaaattgagggatacgactgtatgatgacccccgccttgcttaatccacgctttgacgccatcctgaaaattcggcttgattttccagagcacacgtgcaaccggtaaatgaggtgctgcttcctctggctcaaaggctgcgacttcttgtatgagccatttgaaatgagtcccaaagtcagcaatagaaacaacaacaccttcccctgcttttccatcaaacacaagacgagctggatcctccctgtttccaattccaagcggagatacgacaatgacaggtttcgtatgggcgagcgccggatctacttctaacatatgagattgcagcactgcttcctgtccagaggtcatttcatacgtgtagtcctccataaaaccagtggattgatgatgactcatcacttttaataaccggtccagcgcagccgttttccaatcaccttcccctgcaaagccatatccttttgccattagccgctgtaccgcaagtcctggcagctgtttcattccatgtaaatcttcaaagtttgtcgtaaaggcattgtacccgccttcatctaaaaagcgtttgatagcgatttcatagcgcgcttgcaccttcacacttttttcccattcttcaactgaatatgtcccataatccacatcatattgcgataaatactccgcaaataatgcatctacctctgcttcttctactgcattcacatattcgacgagatcgcctataccaaagtaatcaaccgtccaccctaactgaatctgggcttcgattttatcgccttctgtaacagccacgtgacgcatgttgtcaccaaacctagccactttaatctgaaagctttcatgataggcagctgccacgtccatccaatcagcgatttgctgctgcacatccggcttagaccaatgaccggcaacaatttgattttgtttatttagacgtgcattgatatagccatattctctgtctccgtgtgccgattgatgaagattcatatagtccatatcgatcgtgtcccacggaatcttttcataatactgtgtgacaagatgcaaaagaggcttctgcaaaagattggtcccgcgtatccacatttttgccggtgaaaatgtatgcatccacgtcatgacgccgacaacctcatcacgataattgacctctttcatcagctttgtaatttgatccgcgctgacagctagctcctgcaagattactggataaggaagtaaaccgctctcatttaaggcatccgtcatcttttgtgcatctgcttttactttctgcagtgcttcatctccgtataaatgctgtgatccgacaataaaccagcattctttatgttgacttgttaacatagatatccctcttttctttatcttgaaggtttttgtccgtaatacgcatgttctccgtgttttcttaagtaatgtttatctaaaattcgctgcggaagaggctccgcatattcatttaattgctttgcgaacaaattcattttggcaacttcatctaaaatcacactgtttgtgaccgcactttttgcatctttgccccacgtgaatgggccgtggccttgaagcaaaacacccggcaccgccatcacatctaggtttcttttctcaaacgtttcgatgatcagccggcccgtttctacctcataaccgcgattgatttcttcttctgtcagaaatcgagcacacggaacagcgccgtaaaatgtatcggcatgtgttgtgcccattgcctgtaaatcgagacctgcctgcgcccaaacagttgcccacatggaatggctatgtgaaataccgccaatttcctcaaagtgtttgtaaaggacagcatgtgttgctgtatctgaagaaggactgtattccccttccactacttcaccgtcaaaatcgaccacaaccatgtctttcgctgataattgatcatacgctatcccgctaggcttaataacaaatagaccgctgtcacgatcacacgcgctgacattgccccatgtgaatttcacaagtccgtattttggtaaatctaaattggcttcgtatacttcttcttttaagcgttctagcatacggttgtcactcctttctttggcatcagatgtgctactgccgcctcttcaatcggaaggccatcttgatagcgctttaaaaattcaccaaagcctttgacatcaagcggatcgggttctatcagttcttctgatgtatgggcaaacacttgatgcgtgagaaattcagccaatgtttgcttttgatgatggatcatataggaagcgaggacagccattccaaacgcaccgccttctcccgcagtggaaacgactgatacaggtgtattaagcgctgccgccaccattttttgaccaacgagcggtgttttaaataaccctccatgtgctaataaacgatcaatcacaacatgttcttgttcttttaagcgatccatccctattttcattgcgccaaaagcagaaaaaagatgggtacgcatgaagttagccagattaaagcggctttcagctgatctgacaaaaagaggtcttccttctggcagtcttgtaatattttcaccagaataatagccatagcttaagagtccgccgccatctggatctgcttctaacgcctgctgcaataaagcttcgtacaccttttctgatgctactcgcatacccaatgcgtcaaatgcctctctgaagatattcatccaggcatttaagtcacttgtacagttgttcgcatgaaccattgcgactggcagtccgtccggcgttgtgaccatatccacctctggatatacaccctttagctcctgctctagcacaatcatggcaaaaacagatgtcccaactgaaatgttccctgttcgtttttctacactgtttgttgccaccattcccgttccggcgtcaccttcaggggggcaaaatggaatgcctggccgcaaatgtttgccttgatctaaaatggctgctcctgctgccgttaacacgccagcctcctcacctgctaaataaacacgcggcagaagatgacgaagcttccatggatagcctttttctgcgatcaagtcttcaaattgatggagcatttcttcattgtaatctttcgtttgttcgtcaattgggaacatacctgacgcatccccaatgccaatggcctgctttcctgttaacagccagtgaatgtatcctgatagggtggtcatatattctaaacgggaaagatgtttttcctcttctaatatggcttgatacaaatgggcaatgctccatctttctggaatatggaattggaaaacatccgtcagtttttgactcgcctctatggttgttgcattccgccatgtgcggaacggaacgaggacctctcctgtatgatcacatgccacatagccatgcatcatcgctgataccccaattgagccaatggtttgaatggtcacgccatacctttgctcgacttgctctttcatctctcggtacgctacttgaagacctgtaatgatatcaattaagttgtacgtccaaatgccttcctgaagagaactttcccattcaaatgcaccttgggcaattggctgaaacgcttcatctattaaaatggctttaattcttgttgaaccaaattcaatccctaaagatgtccgtccttcttttaaggctttggtcgtctcttcatgattcattctgcgttcacctccatgattgatagcggttccaattttaattttctagattcattgattctctgtgcacattcacaatataatatttgtacgtacatatgtcaataataaatacagttgtgcatacacaatatgacaaaaaccgtacttttctaaagctgagacgacagaaagggaaagcgcctgttcttgattcgacaaccatgttaaaatatgtccatacaatttcttctcaatccgagtagatgatcaactgagaaagaagtgaaacgatgaaaaagaagtaccagatcattatcgatgatataagaagcaaaatacttacaggagattatcggatcggggaacgtattccaactgaatcaagcctgcaggagatgtatcaagtgagcaggcatacagttcgaaaagccatcttagaattgtcgagcgaaggttttttgcgaagtgagaagggttcaggcacatttgtgaccaatcaatatcaaacaaagcctgcgggacatgcgcatatgaaaacgattggggttatcacgacatacatatccgattacattttcccttccatcattcgaggcattgaaagccgattaaacgaagagaactattctttgttactggcgagtacgaataatgatgtagaacaggagaaaaaagcgctagaaatgatgctgtcctttggtgtggacggactcattgtcgagccaacgaaaagtaatttatataatccaaacatctcgtactatttatcttttaaagaacaggatgtaccgctcattatgatcaatgcttattatgagcagttagaggttccttttctctgtttggatgatgtgaagtccagttatttagccacaaaagagctgattacctcggggcatcagcaaattgggctcatttcaaaaacagatgatttacagggaaagtaccgaatgaaaggctatattcaagcgctcggtgaagcgaagcttaattttctgcctgagcacgtcctctttttcgatacagaatcgaagcagcatttgggggatgatattaaaactttcttattaaagcatcagcatgagctgactgcccttgtttgctataacgatgaggttggattagaggttgccaatgtatgcagtgacatcgggctgtccattccagaggatctctccattattggacaggataattcatatattgcccagaaaaatgcccatgtgaagctgacaacactgacgcaccctcaggagcaaatgggccgggatgcagcagactggatgattaaaaaggtgcaagggaagaaaaatctccctcatcaaaccttttatgaacctgaattggttccaggagaaacgatcaaacaaatgcatgcaagaaaaaaatgagcccttgccgcaagaggctcatttttctatgattagatctcttctttaggagtaggcactgcgcatacaccatctgcacatgccgcttcaaatgaattagaagccgctttatcagcttgagctgcttcttctgtccaagccgtttcaagtgcacgcaggaacgtatcggctggctgtgcacctgccactgaatacttgtcattgatcaagaaaaacggaacagcattgataccaagctgtctcgcttcttgttcgtcttttcggacatgatcggcaaactcttcgccgcctaaaatttgctgtacttcctgcaaatcaagacctgctttttctgcaatgtctaaaagggtttgacgatcaccaacatgctttccatctgtaaagtatgcttgaaacagctctgccatgacgaaatcgcctttccccatttgaccagcatattgcgccaatcgatgggcatcaaaggtgtttgtcaacacgagtggatcaaattgaaaatcgattcctttctctttgccggcctgcttcacctgctcattcatcgccatggcctggctgcggctcatcccatattttttaacgagcatatcatggacatcataattgacctcagcaggtgcatgtggatcaagctcaaagcttttaaactcgatttctacctgttccttttgagggaattgttcaagcgctgtttctagttgtttttttcctatataacaaaaaggacaggcgatatctgaccagatttgtactttcatgttcatcttcctttcgtgtttacgctttttctttgacgatgtaacaattatagttacatcaaatcggttatgtcaagattctgatcttgattgaaatgaaaaagcctctccttttaagaaaggagaggctttgaaaatgactattctaaattggcatggtgaccatacattgtctgtgtgtcgagctttttcatttccattaaccgcaaaataaccgcatcgtatgtcagaagaagcgactgctcaaatagcgagcccattggctgaatggtatgatggcttccttcctgttgatccttcggcgcacctgacagtaagatgacttcatccgatagatcagctagaggtgactgagcagaaagcgtaaaagctgccacttttccgccaattgcttttgctttttttgcaaggacaagcaaggtctctgtacggccagagccgctcccgacaatcaagagatcttcttctgtaaaggaaggtgtattggtttcaccgatcacatacgccttgacgccaatatgcgtgagtctcatggcaaatgattttcccatcaaaccagacctgccagcccctgtcacaaagacctttcttgtagttaaaatgcttgagacaagccgctctgcttgttcgtcttgaatagcgggcgagtgctcagaaagctcatttaaaatggctttcacatagtcactggttttcatgattgtgcgatcagctgcttcatttgtgcggccacttctgctttattgtcctggcttgcgataccaccgccgacaatgattaaatcaggatttaatttcacgacttcaggtaacgtatcaagcttaattccgcctgcaatggctgttttcgcttgtttgacgacttgtttaatggtcataaggtcagcaaatgagttttgaccaaccgcttgcagatcatagcccgtgtgcacacaaatataatcgacaccaagttcatccagctcttttgcccggccagcgatatctttgataccaatcatatccactaaaatctgtttccctcttgctttcgcttctttcacggctccttgaatggacatatcttctgccgctgcaagaatggtcacgatatctgctccagcttcagatgcctgctgcacttcataaccggccgcatccattattttcagatcggcgagtacacgtaagtttggaaatgcctgtttcacttctttaacggcacgcaagccttcgttgatcacaacaggtgttccaatttcgactacatcgatcgatccttctacttctttaatcagctcaatcgcttctggtatattcactaaatctaatgctaattgtaatttcatgaacgttcactcctattttttcatctcatcttcaagagctccgtggatagagcttcttgcacgatgaaatgagtataacaacaggatggaagcaatccaagtacgcactttttttttacatactatactttttcgcatatggttacaaaaaagacactgtcttttcgaccagtatgtcagcgagcgcacaaaccctcgcattcggtgtcatgtctgtgttctgatgccgctccggtactcggccttcctagactgcaaaggttttcaagtcacgctaaaaaaaagacaaagagctaaaataaagtgattttagctctttgtctacatcggtcatctttctatttatcatcctttaaaaaattgctgtcgagatattgttttccccaatcatacatcgcctctaaaatcggcattaagctttctcctaattctgtgagagaatactcaacctttggcggaacgacaggataaacctcccggtgcacaatgtgatcttcctctaattctcttagctgattgacaagcattctttgcgtaatcccaggcattaacgactttaactcaccaaaacgttttgtcccttctctgccaaggtgccataaaatcagcattttccacttaccgccgataatattcagcgtcagctctttttcgcaattgaacactttattttccatacgtgatgacaacaacattcactcctatcattacaaaccatttaccctttatcatatactgcggcaaaatgaattgcctagcatacggtctttgttattgattttgttttttgacaaaagccatcacagcctttgtcatatcttgcgcttcttttggcgccctgtctgatccaaaccatttattcagatcactatggcttaacgtatgaacccgaaaaacaaaccgagagcctttatcatgatttagtttttctgcaaatcggtacacctcaggattttcccagcctgtaaccaaatagacgggaggtacattcttttgattcatataagtgacaggtgatgcctttgtccaattctcctcttgttttccaaagacttttttgtacgatgggatggcttgtataaattgattgaggtttaacggtccgtctaaaatcacaatggaattaatcgtttttggcgacagccccacacgctttaagtaagtcgaatctgtggcaaccagcgccgtcaaatgaccgcccgctgagtgacccatgacattgatttttgatgaatcgatttgatattcatacgcatgatccttcacccacttaatggcgtttgccgtatcatctgccatctgctcatagttggcatcagggtgaagcctgtaattcattgaaacaaacacatatccttgacccgtaaaataatcagcttttgaagcgactctattcttatcgccgcctgtccagccgccgccatggagatagatcatgactggatgctttttctttttgtcttcatctttgccctttggcatatacatatcgagtgtttgctgtttgttttgtgtgtctgcataatggatattcgtcgtcggcttaggctggttgaaacggaacacaaagaatgcgcataccaataatccagcgatgaccgccgcaaataaaagccacttcatcattcgattcaatgtcattgcacctttctatgttgggatggggaagcatcattcgcacatatgtagagagactaggctgattcatttgatacgacttgtatgacttgaaccgtttcacaataaaaagaaaaatactgttcttcataatcttcgacaaagtaattcaaatattcccagcctctatccaaaagttgaatgttcaatataatatggtcatcgtttgttaactccaaatctttgatttgaacagaagagacattagtgaatttcagacgaatgtctgcttgtagattcggggattcatatgggatgtgcagaacaatacagttgatcaagtcgtaatgttcattatactctttaaagtagtgaaattcattgatttgctttagatggttgatattgaaatcggggatttgtttctggattttttcatttaaaaaccatgtcatcgtttatcctccaagaggttattgtataagtacaatgattcgttttcttgtttcttcatggtattgaacataggaatgcaataaaggataagattcaaggatctgttgatacgttttgatttggggatattgctcttcaaatgactgacgcagcacgtttaactgttttttcggtattcgtttatgatcgaccacataacttaagctccctgcaacaagtgaaaaaaataaataaaaatcatctgaggatatcccagtttcttcttcaaaagagacgatttcatctggataagctgaatctaataagtattgataacgctgctttaaatcgtagattaagccttgtttatctttgctgaacttcatggatctttcccctttctttagacttttatgataaatagaaaatttgcatttgcatcaaattcttcaagaaggtcattgttcaagttccctatcccatgaggatggaagctgcattcgatccatctttctaaactactaaacatctcattcactctcctaacgaatcgtgtcacggagtttgtaaatattcttcaaatgaaataaagtccgctttttttcgaaattcgtttaagatattctgatctcccgtaaaaataacatctgtcgaatcaaaaaaaccgatttcaaacacggcttgagggataacgggtgtataattcacgttccaatatcgttcattatcttcaatttgaggtattgaactgatattcaaatgatttacatgacgaggcaatgccgtcaaaacagcgaaaataaaagaataagaatagtcatgtaagaattttttgaaatgttcacccttcagaaatataaaatccgtgtaatccggcatgacttctgaatgaaattgatgattccgaccatgaagcattgagagtgtcacatcacttgtgacccaatgatactcttctacttttaaattgattttctttattaatttatttacttcgaatagatcttcctcttttgctaatacgattctcattacttgctccacctcatcaattttaaaacatcagacgaaactaaaaatactctacagtatcaaaatcagatcatgtagatatatgtaaaatttattatttagttttataatttcgaatcagttcctttttaaaatcatcaggaagtttttgattcagaaatacaactgaaatccactctaatacaatctcatctaaagttctccacgtttttaacaattgtttattcatttgttctaattgatgaatcgctagtactcctatctcataacctctttcgccatatatgatccatttcgcagaaggggaaacccatatcactcgtgaagcaatatccattatgctatcatttacactctctatcggataatccgttaagagatcaaggtaatcacttggcgtgaggtttaacgggattttcacccaaggataataaccaaaatcatgataataatcatgcatgctctgctgctcatctaatacagccatgagtacatagtcatcatgatgattcaaagctaaaccttttaacatttcccagctatcatctgataacaaccaatggaattcttcgaataaataatgaggggggggcgttttcaacacttgatcagggaatgtttttgtactgtgaacgagcgaatgaacaaacgatagaacatgttcaaattcttttggatcggatataaacaaatgtttcactttatgctcctttcatatctttgggtaaatctatcatcagtcaatgatactccatttcaccgcttgtaacatgacgcataatgagaaagcatttgggtgtaatagtcattgaatgttttttgctccttcaataatccttcaaaccaatttgctaaaacagggtgatccactggtttccacccttcttttaataacctatttttcacagaatctcttgttgataccattcctatgatacaaatttccatatctctatctgtccaaatcgcccactgcaacgaatgcgatagccagaccactatgtttgaattcgttatgatatcatccgctatagacccttttgggtgcgtccatagtgcgtttacataatgctcacctgaaatgttcacactcgctttgacccaattaaaataaccaaattccttcaaataatattcggctggatctggttgaaggactgcagttaaaaattctctatcttgtgtaacagttgataactctttaatggttggtaaaatatcatcactcaatgcccaatcaaactcttgaaacaaaaaacaatcaaatgtcttacggaagacttgttgtggtagctctttatttgtgtcaaacacatggtctactaaattctgatagaatttgaattctttttctgaacgaataaataagtcttcaagccgtttcaaacaactacctccactcttgtaaacctagtagttttttaattcttcctctacatcttcttttaatgttggaatttcaattgaaaccgaatcatttcggttgtagaaaatcgacggattgattccatctgctatcatccccggcagccactcttctaaaaaatcgtctaaatcaatcatttctggcatagattttccccatagttcaatcgcacaataagcggcatgctcctttgtcggccaaaaatgaagctgcggtattcgatgttcatcctctgacatcacccatcccttctcgtttcttaatgaccaaacctcttcaaaatcaacaatctttttaatgaagtagtcataacgctttttcgcaggtaattggacggtggtttctaattctttcggatgcatggacattgcgtcactccttttagattggggcttaaccataagaatatatatagaaagctgataaataggaactagaggtacttttctatccagtcattcaaatcatcaacagaatgtaagtaagaatgaggtgaatctttcaaatcaattccactcaaaagaatcaacatatcccaaacttgatcatcttctatttctggatcgtctgaagaaacataaatttcagcccaatcagacacttgttctcttgtgatcatccccttcaagacttgtcttattttatttaaacagtctagcattttgggttcatccattcattacaccattcctttctcaaaactcacttctcgttgtaaactgcctatatttcatatttgataatatcctccattgacattcctttaaaatataatgaaagaatgtttataatagtgtattcgccatacataccaatcgggttaaatatcattttagccgtttttggatcagcaatctctaagtccataacaggtgccatggaaccttcttttccctcgcttacgtaataattttcatctcggtattccacgaatttcatattttgaagatcctcttctattataaaatcttgctttagttttgtgatgactttccatgaaccatttaaaaaacctgtcaaacctgaatttgcaacaaataatccattttccttttttatcaattgttttaactcacttttttctattctttcatcaacaaataaatcatagtattggattaaaatatcatcatattgatttttcccctcacccgaaatgatcaaagcatagctcaattttccaacttcttttaatgggagttcaataatagcgcctggttcaattttagataaagtttttgcttttttagttgttactttaatatccgttacttctttctcatttaaatcatcaaaatagtgactgcctccgttatttaagaccgtcatgatggtcaaaagcatctcatccatcgttggctttctctctaaatgttcctcagtcatttcataaaattgttcgatcgcttcttcaaaaatatctaacccgtcatcactgatcatgatgctctttttcttatgttcttcttcccaaaagcccatttggaatacactccttatatattgcgttctttattttctcattttgatttatcacgataaatgtatacttgtataaactgttttatttgcacgtttgaaaagtaccacttcattatccgttagccatttaagctctcgcatatgatacgagatttcttctaagtaggtatcggtttcagcaattaactttttatctaagatatttctttttttgtcttcaactacaagataaagagtaaactgctttaaatctaattcgataagtgggtaagctttcttttttttatcgggacttagttttgttttccctttaatctccgctttatattccttctctttcattttcttaaatgtagctttgactagctgactatcccatttttttaattcacacagatatagcaacgctttttccaaagtatcagctaagatttttttcttattggttgcattttcaaatccaccataactgaagggtacttccaactcgtatgtatttcttaaaaataagaggtcaggctcaacttttgaagtactaattaatttatagtcttcaaaagacccacatataaaaacaatagcttcacaatctttcgtttgaaatttcttttctaattcgtataaaaacatttcagtcatacaaagggattggctggctaagttcccacgatcacaatcttgcattaattgtatatttttcaaatacactccttataagcctcctaataagattttattcatcatagctttgaatggttttctcatgaaactcttcgccattaagatatctactgaaaaatatatggatgaaggatatcatgctgtaaaacaatctgaaacttgaatttctctccctctatatttttttccatatacgaatcgtcctaattcagcattgattgttaatcctaattctctaaaatctttttgcttttctttcactatactcagtgcgatttttgttatttctttttcgatatctttgattgttttggtaatcgtgtttaatttaactttcttcaacttttcctccagtataaaaccctccctaattcctagagagggttttaaatttaatactaaaagtaattcatgacattcttactactacattaatttacttctatatagcttattttctaccaaaatataaagatattctccaactactttgtaagtaggatcacactgtgaggggtcaattccatctaaaaataatttcataataaacgtttcatcgtcaactattttaaaagcatactgtttattttccatattattaaataacaagatttgtctctcagaaacatatagttggtcacagtacctgtattcttttctatctaggtggtacattttctttttttgacatgactgattttcagggtttaaatcgtaagaaaaagttgaaataacaattgtttgctcttcttcatagctagtgtatagttctgaacctagagtttgtattgaagagcattcatacattatccctttaaattcttcctcaaataacatttctcctataattaagttaatacagtaaattcctttacccttaggatttaattcatcaaatatcccctcttctgacataccaatccataataatccgttttcatccagatgaaatgtattaacacctagtaaaaatgaacatatttctaccatattattttgttttaaatctaaaaaatttattttacatatataatcttgttcaaacacaatgacaatggtatcgtttatttcttgtattaaataaatatagctatcagaatcaagttcatttaatgatttattcattataataatatgatccttgactacttgaagtattagttgatcatcaataagaaataccttatatattttctcatctcttccaacattaaaataaattagatcttctttaggaaaatcaattactttctctgtagttattttacttatcaataatctcaactcctaatatggaaagcttgtccttaaagtaccatctttttggactaccactctaactctctttgttttttttcctttcccattgacaccaacatattttttataagttttctcataaactgttgagccaggtttattcccagctctagcctttcccgtcttcaaggtatcccgtgtagttctttttaatgttttattacttctaaatttccccttatttttctttttagattttgcagagtgacctgatttgatatggtcccaatcaacactctttacttttcgtttcccactgcttttcgaaaaattataagcccttttcgctccctttaattttccaccacccaaaaatcctgatacggttgcagccgccacacctttccaatctttccctgatttatgtgctttgtatccatcatataccgcaaatcctgcattgacaacaaaccatacccaatggccgtctgggtctacattcatgactgggttgttgtttccataggtatatccgttttgatctagcgaatctccatcacttcctgggtctgggtcaagtgataggaatacgccattttttggttcatagtagcgagcgattagatagtaaagtcctgtttcttcgtcgaagcggtaaccagcatagcgatatgggtttccttttacttcttcattttcttttacttttgttggaacgccccatgtatcgtattcgtactcagcaacgatttttcctacactatttgtgatggccatgacatcaccgtgtgcattgtagtgatagaaatatttgtttccattttgcgtgaatgcaaggagttgtccactctcaccgtatgtgtatgcttttgtgacttcgttgtctccatctgtttcgtataaaacattcaggctatcgccgtcataaaaataattggtgacttttccattcactgttttttgaattctgtatccacgctcatcatatttgtaagtgacaaatggcttgtcttcgccttttttcttgatggccgttatgttatcttctgcatcccattcataaaggaattgtccgtcagacgttcggttgccatttttgtcataagttaaagtctcatcatttacctttgtcagttggttcatgatgttgaatgatgcgttgattgtttttttagtgccatttttttcagtcgtgacggtttttctgtttccaaacccatcatatgtgtactcaataaccgtgccatctggatgagtttctttgatcaattgatctaattttccatattcataacgaatcttcccgttgcttccttgatcaaccgttattctgtttccattttgatcatattcgtaagcttcgtttaagatcgtcgtgccttggcttgttccaatgtgcaaatcattgattaagttgcgctcatcataagcaaagctagcaccactgccgttacctgtaataaaggactgaacatttccattttcatcataatcaaacgaatacgtagaattcgaatccttcatctgcgtcatttgatcaagcttattgtaactgaattggttcgtccctttttgatttccgtgtgtccactcaaaggatttcagtttgtctgaatcggctggatacgtccaagtttggctgctgccacgctctgttaactttgtgatgcggttttgttggtcgaacgttctgtttttagttgtgttttgttctttgttgacaaccgttgtttcgtttccgtttttatcatagctaaagttatatttttctgtcccattgtatgacttggatttcactcggtctgttccatcatacgtgagagacacttcatgtccattagcagaaatggttttgattaagttgctattcgcatcatattcactttttaacacattccctaatggatcaatggtttttgtcaatttgcccatcaggtcgtattcaaactgatacgtctgatctgactctgcacgaatggttttcgactgttcattgccctctttatcatacgttctcacaatggatgtcccgttagataaagtgattttcttcagctggtcagcctggtcatattcgaatgttgttttttcgcctttcgcatcggtttcagaaagttttttgcctgtttcgtcgaagacagattgagatgagtaaccaagctcatcctcttctttaactgcatagttccctttttcgtcgtaagtggttctcgttaaaagactaccttctactagacggatatcatcaaaccaaaccgttccagtcgcgcttttttggaaaacaatctgaacgtcgacttttttcaatggttttgtttttggtatgacaaccgccgctcggttccactcctgtgtaccggttgggaatttcgcattaaacgttcctgttgtgccatctgtatacgtaacgaacgcttgaaatgagtaatcattttcatttgaggctttgacattttcagccttagacatcccagttaatgtgacatatacagattgatcattcgcactttgttcaatcggtacagattgtttatagatggcatttgcttgagttgaagaggttcttgtcatttttaacgaaacgtcatcgttaaagccttcttcattatctaatgaaccacctgttccgctccagcttgttgttttatccgtaaaggaattatttttgactggattataacttgatgaaacttcgcctttttctagctgaatctcatcgaaccaggcttttccttttccagccttatctcgatgatccacttccatatagatcacagctttgcctgcatgagatggcgtcgtaaacgtgacttggcgttttgtccaatcgttttttcctgataatgtactgtaaccgttactgatccattgaattcgtttgttgtttgtatctcttaaatcgatgttaaaaaatgctcttgctttcgttagctctgtcttgatttttccactcagtgtatacgtcgtatttggctctagtgtcacttcttgagtagcagaagaatagccaagttcggttccttcagttgtcgattgtgaactgatctctaataaccggccgccagataacacaccacttttcccagctgtttgcgctaatttcccgtcatccttagatgctgtaagtttccagccagttagcgtatcttcaaaactgccattttttaatatactcgcacctgcagcaagttctttactcgtttgtaccaaatttccgtacgagtcataaatacttgctgaagacatatttccactttgatccgtttcagatacagcatctaatccatcataggcgatatctgtaatatctccttctgtatctttcactttagtgacatcattatttttgttatactcgtaggtttctgtcccataagcatctttcgcctgaatgacgttgccatttttgtcatacgaatagctttctgtagcttttcctttctctacatcatttgggtcagtttcttctacgatttggttgccttcatatttcgttttagtggtgattttaagcccttccgcatcatctacaacttgaattggattggctgcttcgttatacgtatactgtatttttcgcccgtttggctgcgttagcatgagtgtctttttagacaaatcatatgcatactcaaaggtttctttttttgcattaattgccttgactaaacgatgattttcatattgatattctgtaaaaacaggctgatcttttgtactgttttgagagaattgtttaatcaatctgccttctttatcgtattcatatgagatacttgttccatctgaatcaatgactttcgttagtaaacctgcatcatactcatatgaaagctttttcccttttggtccttgaaccgaaatgatatgaccatcttcatcataatcgattgatatttttcggccagatgcatcttccattgaagtgagctgattgttttcgttatatttgtatgtcgttgtatttttatgtccatctacaaccttggtgatcttcccaccatttttactaaagtgcgcaaaggtttgatccttcgtttttaacatgtattcatcttttgattccgttaattcaagaaaaatacctgttggtggttgatacgtaccatctgctttttttgtaaaaacatgagttgtggcatcttcatcaagatagatggcaccttcttttgttggcgtgatactcgtttctacatctgcgtaccacccttgaccaaacaggtggtcagctgcatctaaactgttgtacgttcgaccaattccaattcctggtcctcttccatcaatcgacatttcttcttcactgacaatcacattaccagttgcaccatttagctggccgtctggtatatcaataatcgaccagtaatcctctgttccaaggaattcggcaccttcatggaatgtcgggttaaaggctggtgtcggaatggtttctccatttgcatcgtaggcggaaagagtaaaggagtagttcttgcgtcctttataatttccattcgcattttcatatactggtgatgggtctagcgctaattccccgcccttaccatctgtatgaagcacatatttcccacttttaacttcagtaggagtcggccaaatgttcttgttttgtgttgtccaatgatcgacatcgccaacatcaaatgtttgatacgtcttaccattatagatattaactttatatccttttgcattttttaccttatcccaatgtagattgatataacccgtttggctctcttttgtattggtataagcatatccagataaagctttcggtctagataaatcaggtaaagttggtccagctggcggtgaagcaatggcttctccatctttattataggcaatcactctgaaggaataatgtttttgagccccatctcctccagcatttttgtaagtcgcaccaggatgaattggaagctccgccccttttccatcttggaggtgcaatgcatatttacctgctttgatctcagcagctgtcggccatacttttttcccttttgttgaccatgatgtttgattcccaagatccaatgtctcatagcttttcccattaaacatttgtatcttataaccggtcgcaccggatactgaattccaagaaagatcaaagtaacctgttgcgttgttattattgaagccttttgtactaggtgctttcgctctagctacatttggcacgacaggttttacttttgctgacattgcgccttcaccttggtcaaaaatcgcacttacagctccccaataatttttacttgtcgcataattgccgcctgagtttttgtaaactggggaaggatcaactgctaattctgtccccccttttccgtctaaatgaagtttatatttcttagctgcaatctcgctcgctgtcggccaaatattcttcccttttgtactccatgatgctacatttccaactgaaatggcttcatattcttttccgttgtatagccacactttgtaaccttttgcgccagacacctttttccaacttaagtttaagtaacctgtcccatttccattactaaaaccttttacagttggtgcatttgcctgtggaatggtatacgttacttcaatgactgatttattggtagagtttgttgatgagattatttttttccaatggtcttgcccatttccatttgcatgtaatttaaaaccatagttagctgttccgctatcccaagctttgatggttgatgtcacatcatagctcgcccattgtcctttatatacattggctttgccgatgtttttggagcttggtttattgttccacgttagttttgtatgatcatagttggcattcactgtatccagccaaagaccagtagccttcgtcccgtaatatgaatgagcaacatacgttttgagcgtcgctttcgttacattcatatgttgaatcggtttgaatgagttaaacttcatgaacgcatagtttgtaccagttgttttatcgtaataacctgttttgagtacataacttttaagtttagcgtcccatttttgcgtagaggatgaataatttgttgttgggtacttactcatgataaatgtgtctgctgatacagataaagaagtcgaaggatcgatagacacaggataaactcgttcaggatctttgagccatttttcatctgctgtcacatgaagtaaatagccatcgtcttctttttctaatttaaagctcacatcttctgagcgagccacttcacctgacttttcatctaaattagaatcagtcataaacggtttcgggacttgaaaaatggtccgttttttctgatcgtaaaatgtaatagaaccgtcttcctcaatttccccagttagatctgtctttaatttaaatgtaaatgaattgtagccatcatattgattgagtacaatatcttccttgatgttttcattaaaggtgaatgatcgtaaatctatatttggaaatacctcttcatatgtaagctcgttggtgttctctttaaattgtgcagaggtatctttggaattgatttctgatttgtttttccctgaagcttttaaaattgaaaattcaatttgatgcttcttgtgttcaaatgtcgcatatagtccttgtttcatttgcttttgaaaagtagtttctaatttcgcattttctgtttctatttcttttttcgagatcgtctttaattctggagagatgtcctcccactcagcatctggagcctctttaatatgaataggatcaggataaacctcttgtgtaaatacaccctctccttcataaaaaagcttgctgttttctgttctttctgaaagaacttctccgtcttttccaatttcatcttcgtcaattcctgccatttcaagggcttttgaatcatctaattcttctaagcgattatgacttgattttgtattttcgtcatgttcttctgcaaaaatatcagaaggaaacattgataaaagcatcacaaaggctaatagtgctgcgatattccttttccattttacttttctttttagtttcatattaatctccttatcatatatttgtaacatttgtaatattacgccatatataataatacatttgaaatgatacttcaatatatttctataaatatatcattctttcaaactaatccatatatcatcaacttatctatatatcccctttttcacacataaaaaagcaccctaaacggatgcttccatcaaatgatattttttcaaaatgcgataggtgatgtcttttgcttctatgccggtgccttcgatatttgtggcgaaaatgtaggttttattttcatgtttgataaagcctacgtaccagccgatacctgatcccgagcctgtttttccgtatagggtagcgtgtttctcttcttcttgtaccatcattcgtttaactgttctcatgttctttaggtcaaatggaagagtctcttcatatagctgtttgaggaaacgaacttgttcgataggagaaattcgcagggtactgcttaaccaaaattgatcgattccgccagatatgtctttgttcccataatgaatggccttcacccaatgattcatacgttcttctccaatgtcacgtgccatggcttgatagtaccagacgactgaatctctcatgccagagcctaatgtatgatctctattccagctgtcaatctctctttttacaccatcccaatatttgatgtcgtattcatctctcactgcgcctgtttggagtccgattaaggcatttgctatcttaaatgtcgattgaggtgcaaagcgctctttcgctctttttttgttatacacccatggggacttttcttttacttcttgaatcacaaacgtgccttcccgatttttaaagaattcatctactgaccacgctgatgatcttgcttcagttgatgaaggctggctgatacaaagtgccatcagcatgatgccagaaaacagccattttatatactttttcttcaaaacaatcgctccttttctcatgattcccatgattgtagcatgcttaagcgatgggacataaggtacgcttgtcctcttttttttcaaataaaaaaagccggtttttatccgactttttgctgtatattagctctcttttttctcttgaatggcctgtttcgccatttttgatatcgtcatatcgtccattggcgggttatgaagcccggcacgaatatctcgatagtaacgctgcagtggacaatctaggcttaagcttttcgcaccgactaaacgcatagctttatcgacaacttgcaaactatgattaacgacggtatgcttcacagcaccaaattcattaattaacagctctcttttttctggcttttcatacaatgtggtcgttgagtagatgacgtggcgtgcttgctttaatagtaagtcgatttcaccaatcagcgtttggacatttggcaggtcactaattgtgccgttgatgctgttcggtgaatgggtgatggcatattgaacagcataatctcttgctgcttgcgcaatgcctaaatagcaggatggaatatgtgcaatccaaggatttagcgtaccaccgcgcggccctttttgcacctcaacaagcatgtcatctgaaaccttcacctgatctaagattaaatcatgactttcagttcctctcatccccacaacattccacgtttcttctattgaaacaccttctgtctcgcgatgaattaagaagaagcccattgcctctttttcttcaatccatacgccgactaaaaagtatgtaagtgctggtgacatcgttgtgaaaattttacgtccattgatgatccactcattacctgatctagtggctgttgtcccaggcttcccgcctcttgttggactgcctgtctgcgcctcgctcacggcacggttgacaagggcgccctttttcacttcttccgcaaagaattgaagctgctgctcattccattgtttcttttcgtagatttcgcctacaaccccttggtgccagccaatggataaggcagtcgctccgtccatactgccgagcgtctcttgaaacagaaccatatccttcacagattgacctccccctccgtaatcagcaggaagagacaacgtcgtatagcccatctctactaatgattcaatattcttttcaggaaaataagcgccttcatcatgttcttttgccgtttgttcgaacgtttcacgaagagattccagctgattgagccatgttttttgaaaatctgtatcaacaaataatgctttagacaaaacgtatccaactcctctgtttctcacaatctatcatatctgatttttccaatcggaataaataaaacacactttacttataggatttaatgtgttaaattttatcaatattaagtacatatgtcaaaggaacgtgatgcttttatgatttcagctactaatctacataaatcttatgggcagacccatgtgttaaaaggcattgatttcaccgtacaagaaggtgaagtggtcgccattattggaccgagcggatcaggaaaaactacacttctccgcagcttaaacagccttgatattccagacaaaggagagctgacagttggtgaagccacgattcaatttgaacgatatcataaaaaagatctgctaaaactcagacagcaatcttccatggtgtttcagcattatcacttgtttcagaataaacgagcacttgaaaatattacagaaggattgatcgtgtctcaaaacatgtcgaaaaaagaagcagaaaaggtcggagagcaatttttaacgcggattggactgcttcataaaaaggatgcatttccgagtgaattatctggtggtcagcagcagcgaattggcatagcccgcgctcttgcgatgaatccttcagtgctcttgtttgatgaacctacgtcggcactggacccagagatggtaggagaaattcttgaaatgatcaaagatattgcgagccaagggatgacaatggtcattgtgacgcatgaaatttcttttgcaaaggacgtggcggatacggtgatctttatggcagatggcgaaatcgttgaaaaaggctcaccggaagacgtcctattgaagccacagcatgaacgaacgaaacaatttttatcaagaattcatcgcggcatgtggcaagaatcggagaaagacaaatgaagcaaagaacagcattcatgatgtccggagtctttctgttatttctttttctgatgggctgtagcagtgtgaaaaccacgacagatgatggtaggaaaattgtaaaagtcgcactaagtgcagaggtcaatccaccctttttagcaacaaatgaccgaaacgaaccaattggctataacattgattatttaaatgaagtggaaaagaggcttcctcacgtacattttgattacatttttggcgaggaagaatcgaatttaattggtgtaggcgcagggaagtttgaaatggcggctaattggttttttagtaatcctgaacgtgaaaagcgtttcctttaccctaaggttccgtatggctattcgatgacaggtttaattgtgaatgaatcagacaaggagattcgatcgcttgatgatatgacatctaaaaagctggctcctgtcagccctagcggaggcttgcgttcgattttaaatcaatataataaagaacatgatccggatattccgctgacgactattgagagcccttcaaatgagcttaacttaaagcgcgttgaaagtggacggtcagatgcagcatttatgaacatttcaacctttgataccattcaaaagcatttaaatctaaaggtcaaagttggaggcattgtgtcaaaggagcctatctatcttgtcctacagccaagcgagaagaagcttgcaaaagatttggaccggatcacacaagagatgattgatgatggaacactgcctaaactggcgaaaaagtggtttggggttgatttctttcaagatattgatgacatctcagagcaaggcgatcaaaatgaagaaaggaaggaagcgtcatgacgtttacagctggagattggctgggcatttttttacaggtgattgaacgcctgccacttacttttctcatgattatcgtgtcattgttttttgccatcatcatcggcttgctatttgcatgtattcgtattaaacaaatcccagtgctgaagcaattggctgttatttatttatcttttacacggagtacgcctttaattgttcagcttttcttgatttattttggactgcctcagcttttgcttgtggcagggattcaaatcaatcactgggatcgtgtgttatttgtgatgatgacgttttctttacatacgggggcttatttatctgaagtttttcgcagtgcgtattcatctgtcgggaaggatcagctggaggccgcctacattgttgggatgacagatacacaggcgttgatcaggatcattatcccgcaggcctttctcattgcactgccgaacctcggaaattacaccattgatcttgtgaaagacacagcaattgcctttacaatcggactcattgatatgatgggacaggtaaagatcattttaggaaataactacggaatcggtatgtttgaggtgtatgtgatcattgcgattgtgtattggcttatttgcatgagtattgaactgatcaccatgctgcttgaaagaaaatttgtaaaaggccgcaccagcctgtcacgttaaggaggcgatttgatgcaaacgattgatattcaatttgcgattgaccaagtacctcatattttaaaaggcgttccttttaccttattgattgcactcgtttccatggctgtaagtctgatgattggatctgtttttgctttcattcgtctcttccgcattcctttactcagacagcttgtgacgctctatgtctccttttttagaggaacgcctcttattgttcagttgttcgctttcttttatggacttccttttgttctaaccaaaatgagcggtacattcgggctgacttttcatcaagacatggtctccccattagctgttgctcttatgacattcagcctccattcagctgcccatttaacagaggttgttcggagtgcacttcttgcggtagacaaagggcagcttgaagcagcaaaaattgtggggatgacaacacgccaagcgatgatgcgcattattttgccgcaggcatttgtggtagccctgccgaacttaggcaatcagctcattcagctattaaaagccacctctctttcgtttacgattggagtacttgaaatcatggggatttcccgaatcattgcgaacgacggctatcagtttttagaaacgtatctcgtctctgctatgatctattggctgctgagcattttctttgaactcgcttttgccttgttagagaaacgtgtcagtgtgtacggaagatctctcggacgttaaaaaagccggtcaggctcaaatcctgatcgactttttttattcgccttttttcggtgtgttaaacagttcctttggtgcgggttttagttttggtgcagaaccaaacacgactggtgcagaaatatatctaaactccccttttccatccatgcttcggccatgtgcccatctgccttccttacttgcttcccctcttgagaagttaaacagatcataggatacttgctgtttttctagtgagcgcgggaaggtggttggtacgacgacatccccttctcgttcttctaattctttaatcgccgcaatccacatattttgatgatatgtatctcgagcaataagaaaagaaagcatatccttcacgcctcgatcatcggtcatttcgtagagccttgtgacctgaagtctcccttgtgattctgcatttaaattggctctaaaatcagccattaaatttccgcttgcaatgatatacttagcattccacggatatccttgactatccgctgccatggctcctaaaccggcaacaattgcatgctgaggattcattccgcccataacagctgcaagtgctggatcactttcatacgcctgttcttgttctttaacaggtgctttatcaagtaaacgagcgatcatcgtcgcaagcatttccacatgaccaatttcctctgtccctatgtcaaacaataaatctctatatttttgatctgctcgacaattaaagccttgaaataaatattgcatcatgacgctgatctcaccatattgaccgcctaatacctcctgcaatttttttgcataaactggatcaggctttgagggctttgcttcatattgcagttctttgatgtgataaaacatgatgtcatctcccttatcaaaaacatcttttcatttatcactattcaaccgcatgcctctttatgaaaaggagcaatcatgtgcataaaaaaagagaatggcctctgccattctctttatcatcctacttattcagcactcactagaattttcacttgatctttttcattgattaatgcatggaaaccctcttcaatcacatcgtccaacttgattttctttgtgacgagcgtatcagcagagaaatagccttttctcattaagtttaatacagatgggaatacgtctctgtagccgataattcctttgactgtacgttctttaatgacaatgtcatttggcagaatttctgcgcctttttcccaaatactcacaatgactgtttcacctgaaattctagttgattggattgcttgtttcaatacaacaggtacacctgtcacttcaaaagaaacatcgacgccaccgtttgtacggcgtgcaatttcttgaaccacatcttcatattgagaaggatcaacaatgatcgctccaagctctttcgctttttcttggcgttctttagataattctactgcgtaaatatcagtagcaccagctgcttttaatgcttcaataacaagcaagccaattgggccgcagccaaacactgccgctgtatcaccagcttgtactttactagaacgaaccgcatataaagcaactgctgaaggctctacaagtgccccttgctcatatgaaatttcgtctggtaataaatgaagtaattcttcatcgacagatacatattcagagaatccaccgccgcctccggcaagtcctaaaaagcccatgttttcatctaagttgtaagcaccttggtgtccatgagttgcaaaaataggctcaacaaccactcggtcgcctactttgtaattgctgacgtcttctcctacttcaacaacctcaccagaaaattcatgtcccagtgtaataggggctttttcttttgtcagtggatgaggttcattcactggaatgaagataggtcctcctagatattcatgtaaatcactaccacaaatgccgcaccatttcactttaagtttcacttttcctggagcaacttttggttcatcaatttcctctagtcgaatgtccttttgatcgtgccagcgtagtgctttcatgtgtaagactccttttctcatcaatttcattaacttacttaaataatcataacataatttttttaattttctaagtaagatgcactatctttttgacattcaatggacgaaagatgacaaaacatagcaataaacagacaagaaccatacatagacacccgatgacaacggaggttcggattgataaaacatgtgcaagtccaccagagacccctgtcagcatgatcgtcagaatagcttcaaccaaagcataaaaactggctaccctccccatcacctctaccgggatattcgtttgatagaaagtcataaaacctgtgttcgcaaatgctaaaaagaatgctagtataaaaaatccaacagtggctgcaaacaatgtgctggaaaaagcataaatgagatagccacatgccacaaacaaactgcccatcccgagcatgatcgaaacaggcagcttctccacaatgaccgaattgagacttgcgcctgcgataatgcctgccccagctatactaacaagaagaccatattgtgtatcagttagcagcagcacttcttttgcaaaggctgtttcaagagagtcaatggcagtaggaagtaccgagatagcggcactaaataataaatacaccgccatcatttggcgtgatgtcaaactaaaccgaagaacaagcttcgcatcctcttttaacattgaaaaggtaaaaccattttggacagcatcttgtttgagcaaattcggtaaacacatcgtgaacagagcagataccaacaggcagatcgcatttatataaatggaaaaaacaggtgtgcctattaaaaaaagcagacctgctgcagcgggtccaagtaaaaatccacccgattgtaataatgagcgaatggcattaaacctttttcggttatctgctgggatcaatgctgtcatatagaccatcgaagctggatgaaacatcgcttgtgccatttgaatgaggaacaccattacatacagggtaagcagatgtcctgaacataacgcaaagggtatacatgcgatcaagatagcccggctaatatctaagctgatcatcactttccgctgattcagcctgtcaatcaaactgccagaccagctgtttgtcaaaagagccgcagccggtctcagcatatagacagctgttacagccagcacagagcccgtttcttgaaaaatgagcagatggagagcaatcatataaatccattctcctatatttgcaattccgatagctccaagcagcaaactcatatcccgccaatgttttttcatcacttttccccctatttgtcataaaaaaatcccgcccccaagacatttctgtcttgaggacgggatttactccgcgttgccacctcagtttattcatctgttgccagatgaaccttagcaggtcatcatgaacccatctctgtaacgggagaatgtcgctgcaccaccatccgaaggaatccggtgcagagctaagaggtttggttccatcatgctgcccggctccttctcagcttcacggagttctctgtgcgggacggctcatgatgtactcttctctatgagcgccatgtctttatttcatcatgatcttcagctgaattgttacatattgtactgcgccttgatcaaagcgtcaatgtttttttcgagttaatcagcatagatcatctttctggtcatgccgccatcaacgactaaatctgtgccggtcacaaattgattctcctcatcggttaaataaaagcaagccttcacaatatcctttggcgtgcccactcgattggaaagatgctgcttgtggtcaatctctcgaagattctcctcatctttcgtttcaatccatccaggtgaaatgctattcaccgtgatatgatccggactaaaagaagccgctaaggcatgagtcagcgccgatattccgccttttgatgcagcatatgcttctgtatttggctctgacatggtcgctcgggtggatgaaatgttcacaatagaaccgccttttggattctcttttatataacgtgctgcttctcttgcacataaaaaagttcctcttaggttcgtctgtaacacacgatcccaatcatcgaccgttaattcataaggcgatactgtgcacatgacaccagcattattaatgagaatatcaatcgttttacagcgctccgccgcaaacgacattaagtgttgaatatccttatcttgcgtcacatctgttttcttaaaataagcttctaacgattcttttttcagctcttcctccaagcgcttccccttctcttcatctatatctgcaagcaccactcgcgctccttcttttgcatagccccatgcgatcatttcaccaattccattggctgcgcctgtgatgacgaccgttttattgtgaaagttcatcgtttatccaatcctttctctatcagatgttgtcgtctatcataccactcttatataagcgatacctagccacatgaaacataaaagaacaccctccaagtgatcgtgtcataggagggtgtttctttggaattcattgatcaaaagcagcctttaaaatgtctaagtagtcggctttcgtaacagtacgaacattgcttgatgtagagccgttttgttctgctaattcagccattttttcaaaatcctcttcttttacataagatagatcttttagtgctggaatacctaaattttttgtgaaagtatacatgccatcaattaatttttgaatcgctacatcatctgaatccgttttatctgcaaagctcatgattttggaaagctctgcgtgcagtaccttgttttcaactgcattgaattgcatgacataaggcaaaaataccgcgtttgcgataccatgaggtgtatcataaagactgccaagtgcttctgctaagcaatgaacggctgcgacatcggctgaaccgaagcataagccggctagtaaactaccttcctgcattttatatctcgcttctagatcagattcattttcgtatgccttgggtaagtatttcacaattgtcttcattgcacttgcacccattgctttcgaaattgggtttgttactttacatgaatagccttcaatagcatgtaccaatgcatctacacctgttgcggctgttatgctttttggcaccgtcaatgtaagagccggatctaaaatcgcaatggttggccgaagcaaggcatgttttaatgtgatttttttatgggaagcaactaacgtaatgacagatgaacgggtcacctcagaaccagtaccagccgttgttgggatacaaattaatggagatagattagcatacgccttcttccctgatatataatcttcaggaatgccgccatttggccctaataaagcaatcgctttcgccgtatccattggacttccgccaccaatcgcaatgaccgctgatgcttgttcctttctaaagaactctgcaccagctaaacattcattatctctagggtttggagatacttgatcaaatataaaaacagaataaccggcttcctgcaaatacgcttcaataggctgaactagccctgcggttctcacaccagaatctgtcacaatcatcactgtggcacccggcaatacaagatcctctactatagatccaatttcttttgactgaccaatccccatcattatgtttgtttggcaatgatattcaaaattcatcatcatttttctactccttcatgtaaatttgttgagtgagccgtttgtttttctgctccccaccactctatttcttttaaacctggaatgctagatgcataaaagacaggatttttgcctaacagcctttgctgcatgtaatcatccaaagcggcaaaagcatattttcctaggatagctattgcaatcaaattgacgattgccatgatggccattgacaaatccgccaaagtccaaacgatttgtaagttggcaacagcgccaaacatcatcatcattaataccatgattcggtacaccaataacgctgttgcactgttatgaataaaaccgatattggcttcaccataatagtagccacctacaatagaactaaaagcaaaagtaaatatagcaaatgctaaaaagatactcgcccaagatccaaaatgctgtgccatcgcagcttgggtaatttcgataccagataattcacccgttgtttctactgtcgatagcataataataaaggctgtacagctgcaaacaactaatgtgtcaaaaaacacacctaataattgaacaaacccttgttttactggatgcgaaacattggcggcagcagcggcgtttggggcacttcccattcctgcttcatttgaaaaaagcccacgtttgacaccgttcattatcgcagcaccaatcccgcctccaacgatttgctctaatccaaatgcactcttcataatacttgctaatgctgcgggtacatcagtgatatttgtgacaatcacatagaatgctaagataatataaaacactgacatcactggaacaacgatttgagtgacgttagcaattcgcttgactccaccaaaaatgatgaaagccgttaaaatggtgacaaagagacccatgccaatcggactaataccaaatgaatactgaaaggcatttgtaattgtattcgtttgtactgcattaaaaattaagccgaaactaagaatgacagaaaaagcaaaaatcctgcttggccatttcaatccgaattgcttttgaatatagtaaccaggacctcctttaaaaccgtcacttgttctcaccttataaatttgagccagtgtactttcgacaaatgcagaggctcctcctaaaacggctgcaaaccacatccagaaaatagctccaggaccaccaacagtgatagcaatcgcaacgcctgccatatttccagtaccaattcttgtagcagctccaataaaaaaagcttgcatagaggaaatttcattcctattctcttttgttttggaagctttttcagaaatagaacgaaagacctcttttagtaaaacaatttgcatgaatttcattctcaccgtaaagaagattcctatgcctaataacataaccactaaaatatatgtccataaaaagtcattcactgaattgacaattacttcaaacaaagccatctcccctttgtgaatctgaatatttgaaataacacaacttgcaagcgcttacttttatgatagtaaaaatgttatgatcaatctatagaggttttctgatgatatcaatcggctcatccgatttagagaggtagggaggcttgaagttggagatcaaacaactaatgatgttccaaacagcatcaaaagtattaaactttacaaaaactgcacaaatgcttggttatgctcaatctagcatcacagcaaatattgtggcattggaagaagagctaggaacccctctatttgaaaggcttggaaaaagggtgatcttaacagaagctggaaaacaatttcaacaatatacggataaaattttaggtttaacaggggaagcattagaggctgttggcgggatgaatgagccaagcggcattttgagaatatgtgcatctgaaacacaatgcacctaccggcttcctcacattttaacggactttcaaacaaagtatccaaaagtcgaactgatcttccgcccaggaatagcggaaaaagatgttttaaatctattactagaaggacaaattgatgtcgccttattatccatgaatcctgtagtatcctcacatttacttgtaaaagaattaaaagatgaaccgatggccattgtatgctgcccaacaaatcctttgagcaaaaaacaaaaagtatatccaattgatttgaacgagcaaagattgttgttaacggaagactgtgattatcgctatgcctttgaacattcattaacacaggcgggagcaaaaccgcgaagtaaactagaattagcagatgtagaagccataaaaaaatgtgtaatggcaggcttaggaatcgctgtacttcctgaaatttctgtgaaaagagaaatttcagaaggcaatatcatcaaaatcaattggatggaaccttgtttctcaacgaaaattcaactgttttggcataaaaacaaatggatgtcccctgctttaaaggcatttgttgatttaacagaggattatatactcatgaacggctagcagggatcaactctagattaaataaaagaaggactgttataacacttactgaagaaattgatcattctaaataactaaacaaagctttcttatatttagaatggaaacctctgaatcttaaaagactatttacacaaaaaaacttacaggatatactctcccgtaagttttttcgattatttacattgaatcattatttagaaatcatcccatgcggatcaatgacaaatttcttcgctacacctgaatcaaagtcactgtatccttgaggggcttgatcaaggttaatgacggttgcattcactgctttggcgatttgtgctcgtccgcttaaaatggatttcattaggctgcggtgatattgcataacaggggtttggcctgtcacaaaggtatgggcttttgcccagccgagtccaattcgcactttcagtgatccaacttttgcatcagcatccactgcacctgggtcttctgtgacgtaaagccctggaattccaagtttaccgccaactttggtaatatccataattgtatttaaaacggttgcaggtgcttctccttgatctccatgacctgaagcttcaaagccgacacaatcgacggcacagtctacttctggctctcctaagatattggtgatttgttctccgattcgatcatgttttcgtaaattgatcgtctcgcagccaaagcttctggcctgctccagcctttgttcattcaaatcaccgacaatgaccgtagaagcgccaagaagctgagcggaatgcgctgcggcaagacctactggccctgcaccggcaatatatacagttgaaccaggctttactccagccgaatacgcaccgtgaaaacctgtcgggaaaatatcggaaagcatcgtcagatcaagtattttttccatcgcttgatctttgtctggaaatttcagcagctgaaaatctgcatatggtaccatgacgtactcggattggccgccaacccatccacccatatcaacatacccataggcagagccgggacggtccgggtttacatttaagcacacatgggttttttgttccttacacatgacgcatcgtccacaagcaatattaaagggaacggacacaaggtctcctttttgaataaactccacatctcgtcctacctcaacgacttcacctgtaatttcatgaccaaggacgagtcctgcaggcgcagtcgtacgacctctcaccatgtgctggtcacttccgcaaatattcgtcgtcactacttttaaaatgacgccatgctcacatttgcgccccacattggctttcggtacacccgggccatctcttaaaatcaaatcagggtatccaatatcctcaactgctacatttcctgctcctttataaacgacacctttgtttcccgacattttttcattcctccctttttgtttaaaaatgaagtctctacaattttctctacttctgaagcaattccctgcttcaaatggcacaattgattaaaaaaaagcgaaaaatgtctatcacggagagaaaaatgtattttccagtcaaataaaaaagaaaatattgaaaaaaaagctaaacttttgaagaacggtgtcgatataaggaataagccagacaggtatccttaatcgacaaacaaattccttatatatactatcattccttacacacctggctggcgcctacatcatatacaaaagtctcttcggtgaagagactttttttattcgttcaaacatgattcaattacacgcaaagaagctcctctcacgaagagcctctttttgaatgcttgttcattacctgggaaatattttcatcattttaacgctttgatacagatgtatgtatcatagtgataaaccgaaacttctctaaagtgatacgctgaaaatagtcggctaatctcttgttcactatacgatgaaaaagaatgtgaccgcttttgttccttcatcagttcctgctgttggaaagataagaatacttctccatccacttgaagaacacggtacacttccttcatgacttgctcaatatccttcaagtaataaatggtctgcaccgtaaataatttattgaaagatctatcttcaaaaggtaaatgctcggctttaccaagagtcaagacggctttatcctgttccacaagcttcttatgttttctttttgcatatttgatcatatgacgagaggcatccactccatatactttaccgcgatcaagtttctctgctaccttcgataatgtcatgcctcttccagtaccaatttctaaaatccggtcattttcttgtatatttaagagttgaatcgtccattcattgatattatgatgatttttttccatatagcgggcaacccattttgagaacaagccttttggttccctcatttgttttccaatccagctttgaatcaatgttaacacctgctttgcaccagtaaataaaactatttacgaattttcttacttttcatatcggctcacgcctaacaaagtttaagacctagtcctaattatttgttattgattagacggcaccttttcagaaaatgtttcgcagaacttaaaaaaattttcatctgcataggcgttttcattaattgtgcttagattgatttcgttttctgcatgagctgcatattttatgaatgtatcttgattagataaaggtggtgctagattatgggctttggtggaggttatgctggaggctgcggtggttacggtggcggctttgcaggcggattcgcattgcttgttgtactgttcattttgttgatcatcatcggtgcaagctggatttgctaatgtaaaaggagcaggaaacgataacgtttcctgctccttttctttaataccaataagctcggtactgatacatatattgtctgagcatttcctcttgctctctttgcattcggtacggattgccgtatccatgctttaaggaatgcggaatggatgtatatccgtgccccactgacggaaacctcatatatggtgacatcgacattcgttgatcacctcacaatctccttttacggatatcatatgtgcagatgatcaatgtggagcgtgtctaaacctggtccttctccatcgtataacaatcaagcattgcaagcatcataaacatgtcaatctcctcctttttcaatttttcttttcgtgttttagttcatatactttagttgtttctgcttcatttcttcataaaatgtttcgacttgttgttcataaagaaccgtttcaatgtctttgtattttcgtcggatcgtcaatgtgataaaaaataaatggattgtcatatacgctcacctcccttcagttcgcagcacgcgaaatagcccgcagatcttctttgtcagttgacctgcgggcacaaaaatgcagatcaaaagacagtgtcttccaacctgcaatggatgatacgtaaaatcctcgtttactttaacagttttgaagcgtgtgcaccgtataaggtaaaggaaggacacgagctcttccacaggctgatgacatgatgaaattgttgttgaattgatcacaagtagatacgaataacatattcttcagcctcctttacgtttttaattactttgttagtatatccagcaagcaccattttgtaaacctgtttttagtaaaatagatgaattttgtgtgtttgactaaatttctacagtgattcttgtccgattgtccaatacaatcaaaaaaagcctcctcacgtatatgaggagacttttcgaattaatcttcatctagttcttgcagtttcttttgaaaaaagatcgcgcgtctcacacaaagaaaagctgctaataagaaaacacaatcaattcccatcatcagcatttttggagatgcttcgatgtgttggtttggtatgatcgtaccaatatataaaaaggtgctgacagcaagcaaaataaaagcgtactgcttgtaatctgtcactaaaccactccactttttcttcacttgaatcaccttcctgtttaacatgtctattgatagcttaacatagtaaaagaaaggtagtggcatgtaaatctatccattcactagtgcatttagtccctgcttcatatcattcagtaaatcatccacatcttcaatcccgacggatatacgaattaacccatcagtgatgccaagctcctcgcggcggtcttttggaatggacgcatgagtcatacgagcaggaacagagattaagctttcaaccgctccaaggctttctgcgatcgtaaacagcttaagctgacttaaaaagacatcgacatgttcttcttttccaatatcaaaagagatcatgccgccgtagcctgatgcttgcgtttttgcaagttcatgtccaggatgagcatcaagacctgggtaataaacacgtgtcactgctggatgtttctctaaaaactcagcgattttctgtgcattttgctgatgtgcttccattcttagtccaagcgttttgattcctctcatgagaagccatgaatcctgcggtccaagaattccacctgtagaattttgaacaaaatgcagttcttctccaagctcttctgtcgctgttaccacaagcccgcctacgacatcgctgtggccgcctaaatatttagtggcactatgcaggacaatgtccgccccatattcaatcggcctttggaaataaggtgtgaaaaatgtattatcaacaatcattaagatgttggcttcttttgtcaattggccgatcgctttgagatcagtcattttgagtaaaggattggttggtgattcaatgtaaaccgcttttgtttcaggtaaaatcgcctttttcactgcttcaggatcacttgtgtcaacaaaggtcgcttgaataccaatacgattgagtacctttgtgatgacgcggtacgttccgccgtatacgtcatctgtcaggataatatgatctccgctgttaaacagcatcatcactgccgtaatggcagccattcctgaaccaaatgcgtagccgtttgctcctccttcaaggtcacgaatgacggtttctagtgctgttcttgttggattcgctgttcttgaatattcatatcctgtatgctcgcctgctttcggctgcttataggtgctcacttggtatataggtacagacacagcgcctgttttttcatcaccagttgttccgctgtgtatcatcattgtttttcgtttcattttattttcctccctcataaatacctttacttaagtaccgttcactgctgtcaggaaaaatggtgacgatgactgtcccaggtgctgccttcttcgcttcttctaaagcggcaaacaacgctgcacccgaagaactcccgatgagaacgccttctttttcagcagcttctttcaccattttaaaagcatcatcatcactgacggtatatatctcatcgaataaagcagattccatataatctgggataaattcaaggccgattccttccgttctatgcggacccggatctcctccatttaaaatcgatccttcaggttcgacaacaactgtttttaacgccggatgctgctcttttaaataggcagcacacccttgaaaagttccgccagaacccgctcctgaaacgaatatatcgatgtttccttgcaaatcggaccataactctggaccaagcgttttatagtaagtcaatggatttacttggtttttaaattgtaaaacgcaataggcattgccaaggcttgcctctagttcaagggctcgatcaatcgcacccttcatgccctcttttcttggtgtatgaatgatctctgcaccgagcgccttcatgagctgttgtttttcttgactaaaatgttctggtacgcaaaaaatggtacgcaattgatgctttcttgcactgagggcaagcccaatgcctgtgtttccagcagttgcttcaatgatggttccgccagggcgcaatttaccagatgccaatgcttctcttatgagcatatcacctaaacgatctttaatacttccacccggattcatcatttcaagctttgcatatacctctacaccttccgggatgccaacccctgacagttttaaaagcggtgtgcggccaattaattctgtaatatcctttatgacagccatatgattcccttcctttgtatggaaaagaagggggaatccccttcttttattgagtttgctttatcatacgcaagacaaggtcggttgagtgaatcgctgcttgctcaagaaattgatcaaaggagacattggattctttccctgcaatatcagatagcgctcgaacaacaacaaatggcgttccaaagagctggcaaacttgtgcaacagctgcagcttccatttccaccgcatataactctggaaacttctctctcacaaacgctacacgatccggatcattcataaatgaatctccggttgcaatcgttccttttgccacttgaatatgatcgatctctaaagccgactcctcagccagcttcacaagcttttcgtctgcagcaaaagcagctggcaaccctggtacttgtccgtattcataatcaaaaatcgtgacatccacatcatgatgcctaacatcagtagagatgacaatatcccctacatttaatgtgtgatggaaaccgccagctgatcctgtattgatcacataatccggctgaaagcggtcaagcagaagtgttgtgctgaccgctgcattcacttttccaatccctgattttaataaaatcacttctttatcttcataaacacctgttgtgaattcacacccagcgatgttttcttgtgtagcattctttagttgatctcttaatatcgtcacttcttcttccattgcacctatgactgcgattttcaaatcaaaaacatcctttcattcccttttcttcgcttctacgatccaaacaaaatcattcatttgatgaaaggacgtactaaaaccttcttcttcaaagatttgctttagcacatcgatggatggataatattccgtttctaaatcctcagcaagctgatcgaatcctgccgctttcgctttgttgatttcagcttgatgtgctgcttgattttgaaacattgtatcagcaaagactattttaccacctgagtgaaggatgttgctataggtgtgaatggcttgttttttttcttcgtccgttaaatggtggaaagcatatgaactgacaattgtatccggctcaaatggcggcgctggaaatgataaaaaatccccatcatgaaacacatcgggtattcccttttgaagagccgctttcttcatagcgtctgatggttcaacgccaaatacgttcttatcagctgtgagcagtgccgctgttaaattcccagtaccgcttccaaactcaagaacatcttgacctgcacggcgaactatttcttttaaaataaccggataccggcgaaacacttcttcatactgctcatcatgaccacttaccgtgtcatcataagagtcagcccaatgatcaaataaagaaagaaactcacgtcccattttctttccctccactttatctatttattcctatgcgtatagtatgctttaatccgtcgaacagttcctatcctaccacatcttcagtttctttcctactaaaaaatactggtaggggtagaaaaatatttgctcttttagaggagagagattaagatgaatgaagagtatggtgaggtggatcaaatggattttcagttggattttctaaaggataaaattgaattctttgaagcatcgtctttaaaagaacttgaacaaaagatccaaaaacaaattgaacataatcaggcaattctgctgaccgttcattctgtcagtcatcaaacgactgtgatcgatgaccggattttgtatacagcggttgttcattttaaggcgaatatctaaaaaaagatagcatgactgctatctttttttcatgtttattttaatttctcaacctttacaggtttccagcctttttcatctacccatgtgatttccacgcggtagcgttcgcctgttgatttatcacggatggttccctttgcatcttgaggacctccgttatttcctaaccaaagaactgtcatttgatcttctgaaattcccgtcgcataggacatggctttcatcatttctttccagtcttttgagttagaatcataagttgctgtatgtgaaccggattgctctgttcctacaggctcccagtcatcgctttcgtatgttttgtctacgtcactcgttgagccaccatctgtttctttggcgtcttttaacgcatctttatgaggctctttttcatcatctgacttcttcgtatcgtcgtcttgatcagatgagtcatctttttttgcatctgaatcatcagatgtgtctttcttttgatctttcacatcttcttctgatttttgtttgttttcacttgttgcaggcgccgtttttgatggttctttcgctacatctgaatctttcggtttattaaaaattaacaaactcgttgcgacaaccaaaataagcaccacaacgataccaattaatatgttaagcaccatattcgcctttctgcgcttatcacgatgttcaaatcgagaatttctactcaaaatctctgcactcctttgcctctgttccctaagtcgttactattctaacatgacatgaagggatcttctatgtctgtttcttttcaatttcattgaccttttttacaatatcataaaacgcatcatttgtcttagcctggccacttgcctcgtcaaggtgaacaacgactagtgcgtattttggtttttccaccggaaagtatccagcaaaccatttatgataaagcggattccccttttgatctttactaccggtttgggcagtgcctgatttccctgccacatcgaatggaaggtcttgaaaccttcttcctgttcctttgtcagacgtcaccacctgccttaagtacttttgcagcttttgagctgtatagcggtcaatactgcctccttctggtcgtttgttttgaaaggttagcattgttgttccgttttgatacaacactttttcagcgattttcacttcttttcgttctccgcctcttgcaatcgacgccatcatattggccatttgcaaaggagtcgttttgacatttttttgccctattgcggtttgagcaatggcttttttgacatgcttgtcttttttatccccccacacattgccggtttcttcacgatcaaactgtttgaaatgctgcttatgataaacatccccttcccagccagctcgatcaatgagtccaagctttgcagccgtcttttcgatgatttgatcatctgtttggatcagcttgccagcaagtgttgcaaaggtataattacagctctgcgaaaagctctcagacagattgagcacttcctgcgttccttctggctctccatataaattctttcgacagtcatacatcgtttgtggctggtcgaggtttttttcaattgctgcggcaaggacagcggttttaaaaacagagcctggtgccatggcagtcagcatgtaatttcttgcttcatgccggtttttgcttgtgacgtttggcgtacttgccatcgccagcacactgctgctttcaatgtcgagcagaacagcaccgcccttttcgacgcctttgtctttcaaaaccttctccatttcagcttgcatgttttcatcaattgttgtttgaacttgaagaggataaaacgaatgagcctctgctgtatatttgacgtccatcccaaacaaagggtttcctcttccgtccacatgatataacaattttgtgtcttgctcaggtaatagaaattcgtcaaaggtgctttccagcccaaaagtaccgatttctgtacggatggaaagctcttttttatcaggataacgctttctgagcaattctggattctcactcgtgaagcctaatgtgtggagggcaagtctttttttgtccttctctttcatatatacgccgtacacacctgaatatttcatatcattgatgtctttcagcttttttttcgtgatgtcatctttgagaatcagaggttttttggtttctgtcagctgttttttgagtgcatcttcttccatctcaagaatagaggcggtttgttttaaatgaggaagatcatattgcaggaaaggaaataagatcaccgcaggctgttcttttgtgagaagcgcctcgccgtttcgatctaaaaattcaccacggccatctgaaatgaccacttcttctgtacgctgtttgacactttcttgtattaaattgatatcaagctttgaaaaggattctgtgaaaaacagttgaatttctgccagtctcatgagaagaccgagcagcagcataaaaataatagcacctgtccattgaattctacgttttttgcgcataaaaacacctcgtccttattgtggacgaggtgtttatcgtataaacgttattatgaaatttttacaatttggacgaacatttctccgccaggtgtttgaacggttactttgtcgtctacttgtttgcctaacaggctttttgcaattggtgaatcgtttgaaatctttccttcaaacggatcagcttctgcacttccaacgatggtgtaagactcttcttctccgtctggtaattcaacaaaagtgactgttttaccaagtgagacaatatttgagtttccttcatcttcgataattttggcattgcgaatcatattatcaagcgtagtgatacgcccttctacaaacgcttgctcttctttagcagaatcatattccgagttctcagagaggtctccaaagcttctcgcaattttaatacgctctacaacctctttacgtttaaccgttttcaaatattcaagctcttcttctaacttaagttttccttcttctgtcattggaaatactttctcttgtgccatgaatcattcactccttctattaatcctcatcatacatattttctgcacgtgagtgacgactgaaatatacaagaatgaggactttttcaggccctcattccttctgtcccatatttgtaaaagtccatcttacatggcgtcccttttagatgcaactattatgcctttttttcagacagaaccattatcagtggtccaaagatgatctatctccatcgcacaaactgtggaaaggcacaggaagctcctgtacctcgttcgccatttcgatcatatgtagaagaatagcttatccattctccatcttccaatacataatatggtcagtgtacgatatgtctatgctatattattacaaaattgctttttgatcaagaattgtttgaaaatttgtgatgatttgtttgtcgtttttttaatatacttttttaacttcattctttcgctatgtggtagtgatttctccatctcttcttttcttcattgttttattatcatatcaaacccttaagattctttctgagaatgctgctttaataaaagttcacacataattaacaaatattaacaaggaaatatttggtttttgttgaattctatcaatgcaagaccaaatacatgctagggagtgttttaaatgaacatgaagaaaacaattgtttctgttctatccatctctacattatctttttcactaatgggcatggcttcggccaaagaaacagcggatgtcacagtcaatagcagttcttctggatttcaaactttagatgtgatttcgattcaaaattacagtttacctttaagagttggtgagcgctactctgtctatgattctgcagctacacgttattggacagataaccagagtgtagcttctgttagctctagtggactagtgaccgctcattcaactggtaaagccactatcactctttataaaggatcatctgtcttaggacaagttttcgtgactgtttattaatatgatgttgaaaagacctttacaatgtaaaggtctttttcttctccaccatttactctgctcggttttgaagaatggtttgaatttttgtgaccattaagtcgatcgccacatggttctggccgccttctgggatgatgatatcggcgtatcgcttagtcggttcaatgaattgattatgcatcggtctgacaacagatacatactgttcaatgacagaatcgattgaacggcctctttctttcgtatcgcgtaaaatgcggcgaatgatgcgcagatctgcatctgtatcaacatacagtttaatatccattaaatctcttaggcgttcgtcttctagtgcaaaaatgccttcaacgatgataacatcctttggttcaacatggacagtctcttctgaacgtgtgttgagcttgaaatcatatattggtttttcaatggattcgtaccttaagagctgttccaaatgctcaaacatcaggtcattgtcgaatgcgagcggatgatcatagttcgtaagcaggcgctcttcaaatggcatatgactttgatttttgtaatataaatcttgctgaagcatgaggatggaatgtcctttaaatttttcataaattgaattggtgacgctcgttttacctgaacccgagccgccagcaattccaatgacaactggtttactcctcatgtgcctgttatttcccctttctcatcatgttgctagggtatactttttgattgagcttgaatttgacgatttgcagtggatgacgagcggcatctagttcatttcccttttcatcccaaatcgtctcaattttgcatgtgaaattctcaatttctggcccgaaaaattcgacttcgtcccctgctttaaagaagttacgctgctgcaatgtgacgatttgttctttttcatcataatgaagaacgagacctgcgaaatcaaaagtcgttttctttccatgaatgccaaacatttgctcatccgttcccggtacaccttcgaaaaaggctggtgctgtgtcacggtttgcacatttatctaattcatctaaccattcctgctcaatgacaaaattgtccgggtccgcacaataggcgtcgatgactttgcgatacacactcacgacagttgccacgtaatgaattgatttcattcgtccttcgattttcaagctgtcaattcccatttcaatcatttgaggaatggattcgacaagctttaagtcttttggactcatcgcaaatggtgcgtcttcctctccaaataatggcgcttcctcagaaccttctagtttataaagatcataatcccagcggcaggattggcagcagcccccgcggttagaatctcttgccgtcatatggttactgagcacgcagcggccagagtaagcaatacacatcgcaccgtgaatgaacgtctcaatttcaatatcgaccttttctttcatttctctaatttccagcgcacttgtctcgcgagcaagcaccacacgctcaagcccttcttctttccaaaactgaacagccttccagttcgaaagagattgctgtgtgcttaaatgaacttcaagcttaggtgcgacacgtttacacgtttcaataatcagcgggtcagccacaataatgcccgctactccagcgccttcaatcccttgaaggtattcctccagcccgtccatgttttcgttgtgggcaaagatattcgttgtcacatagattcgtgcaccatatttatttgcaaatgcgacaccttcagccatttcttcaattgaaaagttatcggcatttgaacgaagtccaaattcttttccacctataaagacagcgtctgctccgtaatgtacagcaattttcagcttttccaaatttcctgctggtgcaagcagttctggtttttttgtaatgacacgtttcccgtcaatcatttcagaaataccatctttcaatagtgccatttcctctgcctcctcttatattaataaaccgtttctttaaagaagaaccctgtatcaattgaacgattcactggctgaatctcttcaatccgcttcacccagtcctctttctgatcttcatacgcgtctttgtcagtcgctaataaatcaattgcttttctatataaagacgtcacctctgtcatataagaaagtgactttaaaattccatcaattttaaatgagtcgatgcctgcatcaacaaattcctctaattcgtcaatcatacacacatcatttggactcataatatgagtgccgtttgcatcctcgaaaatagggtatttgttttgacgctcttggtcatgaaggaataatccttcctccatatttctgccttcgacgtccatttgtttgccctggtattcaaagtagttgccaacgagcgtacgttttgattggaacatacatgtcatgccatggacttgaatttcgatttccacctcggcattttctttgatgtcgatgacactgtccatgttcagttctttggcaagaacagcacgcgttgcaccttttctgccccagtagttacaagtgtaatagtttgtcccagtcgtttctgtactccagtggagattcaggcttacccctgtttctttagcggccatgatcacagctgggtctccaaagacgacgccatctacgtttaatgcatcgagaaaggttaagtaatctccaagcagctgcacacgatcattatgataaatcgcattcatcgccacatacacttttttgtgatgcttatgtgcaagctcaaccgtctgtttcacatcttctcttgaaaactcgcctgcaagacgaataccgtatgtttgttcgcctattaagaatgcatcagctcccgcctcaattaatggcagtacatctgacaccttgcttggcgtcacaagcaattctggttttttcatgattggtcacctcttttagtactaatggcgatcccgtctccaactggaataatacacgtttggaaatcggggtttgacataagccattgattgtatcgatcaatttttccaattaattgtttttttcttttatcttctatttcttcttcatagttcgttgccactaaacctttaaataatacgttgtctgtaataatcattccgtcatgagcaagcatcggttcaaacagctcaaaaaaacgtttgtactgcccttttgcggcatcaataaagatcacatcatagggcgccatcgtttggactgttttagccgattctatggcatcaccaaagaacacgtgtattctttcttttaactttaattcctcaatgttccgtgtcgcttcttcatagcgttttgcatttcgctcaatcgtaaaaatttcagcatctggtagagctgtcgccattcgaatggcggagtagcctatcgctgtcccaacctcaagaattttcttcggctttttcatcgacagcagctgcagtaaaagttcaatgctcaccttttccataattggcacatgatgctcttttgcatatgcctctaattgagcgattgcatcaggacttgggtgaattaaatgttcaatataatcattcatttgatcatcttcgatagtcattatttgtctagctccttcatgacctgaaaaagaagagtcctgcctgttgcagctctctttctcgtcaatctttcgttcatctaagtaaaacaacccgatatattttaccacaaagaagtggacattgcgaacctataaaatggatattccaacgaaaaaaactgcaggcaatcttgaattgtctacagtctttttcgattcacatgtacattaattgctgcctgtgatgtatttggctttcgctttgttgtgctcatttaacgtttttgtaaagacgacttctccatttttcttcgcaaggaagtacacataatccgttttatctggatgcagtgcggctttccatgaagattcgccagcatttgcaataggtccaggcggcaggcccttgttgttatacgtattataaggagatttcaccttgagatctttgtaataaacacgggatttatgttcacccagtgcataaagaacagttggatcggtttgaagcggcatgtcctttttcaaccggttataaaaaacactggagatttttgcgcgatccgtcttttccgttgcttccatttcaatcagtgatgccatcgttaacacatcatgtatggacatgtttctctttttcatgtctttttcatacgttctcacgtattgatctgtttgtttaatcatcgtttcaatgatcgtttcgagtgattcatcctcacgataaaatggatacgtcgcagggaataaataaccttctaacggatgtttcacctgtttgccatttacctgtgatgtcaccgttttcggatattttttcattagcgtttgaataaacgcaggatcatccagcttcgcttgcacttctttcgctgaaaaattcgtctggtttgcaatcactgccgcaatatcagacagctgttttccttctggaatcacaagctgaaaggcgtagtctgtccctccagatgtcagcttttgaatcagcgtgtctgcgtccatcgtttgtttcaaatgaaagtatcccgctttaaagccggacgcatttttgtattttgcataataagtgaaaatcgtgtcattcgaaatgagcccattttcttttaaaatgcccgcaatctcacggacagatgtcccattaggaatatgaatattaatcgtttgtttgcttttttgatcgaccggtccaagtgctgatttaacatataaaaagcctgataatgctgcaatgatgatgacagcaaggacagataacaggacgatccccatttttcttttgaaaaatggtcgtttcttttgttctgaaaacatgcatggccctcctcacatctagcttttatagtacatgattcgacggagttcggcaattacttgctcatgcatgtcttgacagaacttgacataatacggctaaaccaacgccgccaccactcccaataacagccatgacatagcttccattcggtaaggcgcgcgcttcgtaaaacagtctcaccatcatcgcagcccctgatgcgctatatggatgaccaagacagagtgcaccgcctcttttattgattcggtcataaggaatatccagcgtacgagcaatcagcgctattttcagagcaaaagcttcattgatttcaaacagtgcaacatcctctgccttgattttctcttgatgtagaagtttcttcatcgcatcaatcggtgcagcagctggaaaattgggatgcatcgccgtcacagcacttccggcatatcgcagcattggctgaaacccatttgcctccgctagcgctttttccatcacaacgaccactgctgcaccatctgcttctttgcagctattggcggcagttactgatccattccccggtgaaaatacaggctttgcccgctggatcagttttgccatcggtcttattttagcggccgcttcatctatactcagtccgtcaattgaaacgatctcttctgaatatgtaccacgtttgattgcatctatacttctttcccagcttaattgcgcatagtcatcttgttcttttcttgtcacagagaatctcgtagcggtcagctctgctgcttctcccatagacggatctcctatccattccggtgaaaagcgggctctttctttcattggtgatctcgaaatgctctcagtcccgccagcgatatacattgagccttctcctgattgaaccatggcgcaagctgttcggattgcttctagacctgaggcacactgcctatcaaccgtcatcccgggtaccaagaaagaaagccctgcttctaatgaggacagacgggccatattcccgccgcctcctacaacatttcctaatatgatgtcgtccggcgtcatccctttagacaaatactgaataagcggcgcggctaattgctctggacgataatccttcagcatcccatttttatcaccgaagggtgtccgttttgcttgtacaattactgcttgcatgacaattgtccctccgcccactttttcatactggcacgtgctatttttcctccggatgtttcaattatttgatccatgacaagccattttttaggcaccttgtaggccgccagtttttctttgacaacttgccgaatcctctttgtgtgctgtccttgttcaataatagcaacagggatttcaccccaatatgggtcaggaacgccaactacaaccgatcgcttcacttctggcagttcatttagcacacgctcaatttcctctgggaaaatattcagccctccatagacgatcatgccattttcacggccgctcatatgcaaatagccgtcttcatccagccagcccatatcataaactgtcagccactccttcggctgtttctcctcatgtaagtagcctgcaaaagacatcgggctcttcacataaattcttcctgtctcatttggctggcagactgtttgatcagctcgcctcacttcaatttgaatgggagaaaaaggccgtccgacagatgaaggcttttgcaaaaagtcatttgaagataagtaggaaacaaagcttaactctgatgtgccgtaaaaatcaaaaaatgtcacatgcggatagttggtcacgagttgtttctttgaaggagtgccccaatctgctccagatgatatgacaagaagcggattgtctctctcaaaagcgtctatttccagcaacgattctgtcatcgtagggacagtatacatcacagtaatgtctcctgcctttaaggattttttcgctttcactggcgtaaatttttctaaaatcgtcactgtgccgccaaagtataatgtactgatggcaccatataaaaagtgagaggataagagtgtaccagctataagaacatgatcttgatgagtgattccaaatgtatcggctgttgtttgaaagcttttgatccatgactgctggcgcctgataaatgctttaggtgaaccagttgatcctgacgtaaatcccatataaaagatagggtcgatctcgctgtcgcatttgttagatggaccttgtgtgatgaggctcattttttccttccattcagataaagaaagaacctgcaaatcttcgctgtacttttcaaatctatttaaatatcgatcctcgataatgacgagagctgcctcacttaacaaaagctttttagcacattcctcacggctccatctcgggtcaagcgggatagctgtccaccctgcacaagcagcgccagcaaatatttggagaaaagaagcaccatttgataataaaaaggcaactcttttttgttcatgagccatttgttgtaaccattgcgctgatagccggacacgctcataccaatcttgataagtgatcctttcttgtccatcaatgatggcgatatgatctgggttcatttctgcatgtgatgcatagctttccgttattctgttcaaactgttcaaactgcacgcctccctttatgcacatccctttttcgatatgacatagccgcaatgattttcaccgtgagaacagcacatatgcccgctttgatgagatcacctggaatataaatcagacttaggagagcagcctgagtgaccttgatatccatcatcatcgcttgaaaaggaatgccgcatagatacaaaattccgatactgcataccgtaaagatcataaaaaggtgcaaagtggtcacttttttcagacggttgatccacaaactaatcatgagggcagccactggataagcaagtaaaaatccaccgcttggtccaaaaaagacccctattccgcctctgccacctgacaaaagaggtgcgcctgatgccacaaccaagagaaacagaagtaaactgatcagtgcctgttttggctttaacagcccaccagcaagcaaaagacctgccgtttgcattgtgatgggtacaggtgtaaatgtaagtaaaatcggcgggatcaatcctaacatcccgatcaccgcagtcattagcgccatttgcatcatatcttgaattttcaatttccatacccctcactcaattcattgttaaaaatagagtaaaaggtacagcttattatgtcaacacgaaataaagtaaagttaacatataaaccataaaaaaagacctgtgaagaaagatcacgaagatccgttcacaggccttttattcgttctattcttcgtcttcttcttgatctaagaacgtatttaacgtttcttcaatcatgtcccactcttcatccgtttcaataggctctagctcgccatcttcaccgttttcattcggtgtgaagcttgatgcatgaatttcaatttcttcattgtcttgctcagaaattgggtagtaaagaacatatgatttgttaaaatggtcgctttcaaaagtaaatagtacttcgcaaagctgttcatttccattatcatcaacgattgtaatttgcttttctccgtgttccatttgattcacctcattttaatttaagctgtctaagtacccttgcaggatcataacagccgccattttatcaatgacttttttacgcttttgtctgctcacatctgcagagatgagcattttttccgctgccattgtcgacaggcgctcgtcccaaagcacaacaggaacattgtacgtgttttctaacactttcgcaaatgattggctggcttcacctctaggaccgaccgtaccattcatattttttggaaaaccaagtacaattttatccgttccatattgcgagacgatttcagacaggcggctgagaccgaagtctccgcctgcttcatcaattttaattgtttcaatcccctgcgctgtccagcccatttcatcactgatcgcaacaccaagggttttcgtgcctaaatctaagcctaaaattctcatgttttacgcctctttatgtgtctctaagtacgatttaaccaattcctcaattaattcgtctcgttctattttacgaattaggttgcgagcatcctgatgtcttggaatataagcagggtcgcctgacagcaagtatccgacaatttgattgatcgggttgtatcctttttcttggagtgcgtcatgtactgtaatgagcacttcattcacattggtttcagctgaatcatcagagaagttaaacttcattgtcttatcaaatgaactcactgcttcttgcacctctcttccaacattctactagcaagcttttttctaaacgctcatctaataccattattctacactacatcgcctgattataaaacggatttaacagattcttcgacagttgccagtgcttcttctagcttttctggttgttttccgcctgcttgtgccatgtctgggcgtccgcctccgcctccgccgcagatttcagctgcctgtttcacaagtttccctgcatgcagacctttttcgatgacgtcttttgtcactcctgctgaaatgtttacttttccgttttgaacggctccaagcacaatgacagctgagcctaatttggcttttaagtcatcaaccattgttcttaaatggttcatgtctttcgcgtttactttttcagttaacactttcactccgccgatttctgtcactttctctaaaatagagcctgcttcagcctggcttaattttgcaagaagagattcgttttctctttgaacctcttttaaatctgcctgcaatgaagcgatacgttttggtacatccttcgtatttgacttcagctcactcgctgcctgctctaaaatcgccagctggtcatttaattcttcgtatgcccctttaccagtcactgcctcaatccggcgtgttccagcaccaatacccgattcagaggcaattttaaacaacccgatttccgctgtattttgaacgtgacagccgccgcatagctcgatgctgtaatcgcctacttggacaactcggacaatatcgccatacttctcgccaaagagcgccattgcacccatttcttttgcttccgcaatcggcttcaggtcaatagcaacagagatgccttcccagatcttttcgttcacaattttttctatctgagacaattcctcttttgtgacttgtccaaagtgagagaagtcaaagcgaagtctattttcattcaccaatgatcctgcttggttcacatggctgcccaaaacgtcttttagcgcctggtgcaaaagatgtgtcgctgtgtggtttttcacaatgccttttcgaagagctgattccacttccgcagtgacttcaagtccttttttggctgtaccgcttacgacgataccctcatgaacatgctgaccatttggcgcctttttcacgtctttgatgtcgataatcacttcagcgcttttcaatgtccctttatcagccacttgtccgccgctttccgcatagaaaggtgtttcatctaacaaaatttgtactgtatcgccttcatgtgcttctgtgacaatttcaccattttgaagcaattcgacaatatgggcatctgccgttagattttcgtagccaacaaatgtgctttctactttaatatctcctagagcaccgccttgaacctgcatactgccgacatcttgtctcgcatttcttgcacgttcacgttgcttttccatctcagcctggaagccttctcgatccactgtcatgttttcatcttctgcgtattcttctgtgagctcgacagggaatccatacgtgtcatacagcttaaatacatcttcacctgaaatctgtgtgctgcctttgtctctttcttttttgatgacttctgacaaaatagctaagccttcgttcagtgtttcatggaagcgttcttcttcattcttgatgacttttgcaataaattcttctttcgcttgtacatctgggtagaaatccttcatgatttccgccacaactggaactaggtcgaacataaacgggcgatggatgtgaatggtttttgcataacgcacggcacggcgaagcaaacgtcttagcacatacccgcgcccttcattggaaggaagcgctccatcacttacagcaaaggcaaccgttctaatgtggtcagcaatgactttgaatgctgtatctttttcctttgtctcgccatagctttctccagaaatggtttcaactgcacgaataattggcatgaatagatcagtatcaaagttcgtaggcacgttttgaatgacagataccattcgttcaagacccatccctgtatctatgtttttcttcggaagcggcgtgtatgacccatctggattatggttaaattcagagaacactaggttccacacttctagatatcgctcattttctccgccaggatataattctggatcgttcatatcgttaccgtatgattcaccgcggtcatagaaaatttctgtattcggtccacttgggccctctccaatatcccagaagttcccttcaaggcgaataatacgttcttcaggtacaccgattttatctctccatagaacatacgcttcttcgtcctctggatggacagtaacagataacaaattcgggtcaaaaccaatccattcgtcacttgtgaggaattcccacgcccattcgatcgcttcttctttaaaataatctccaatcgagaagttgccgagcatttcaaagaacgtatgatgacgtgctgttttccctacgttttcaatatcatttgtacgaatcgatttttgcgcgttgcaaatacgcggattgtcaggtacgacgcggccatcaaagtatttctttaatgttgccacgccgctgttgatccacaaaagtgtcggatcatcatgcggtacgagtgatgcactcggttctacagcatgtcctttttctttaaaaaagtctaaaaacatttggcgtacttgagctgaagttaaagttttcattcaaaaatcctcccttttcattcatcaatctccacacaaacgaaaaaacatcccgccctatgcaagcacaaaacgacttacacagggacgagatgttctcgcggtaccaccctgattatagacaaattcgtctatcaccttcacatccgataacgccggaagagagcggcagtgtttatctgcactcgggactagcttccgttaaaggtctgataaggcttttctcagcaaaataaagcctctctctgaaacagctttttaacgtactcgggtccgtcattgaattcagtatgtagtatgaatcgaaattattatagacaactcggctcctcttgtcaatgaacgcttcgcctcataaggatatattgcacaatgatcaccctgattatagcggcagttggtacggctaaaatcatgcctattaaaccaaataactctccaccagcaagcaagactagcataatgacgacaggatgcatatgaagacttctccctacgataatcgggctgaggacgttactttctaaaaattgcagcacggcaactgtaatcagcacaataataaccgatttcactgagatggtaaacgcaataaaaacagcgggaatcgcgccaataatcggtccaaaatacggaataacattcgttgcgccaattagcataccaaggacaagcgggtacgggatatgaaacagccagagcacagtggctgctgcacccccaatgaatgaacagacaagcagctgtcctctaatataattaccaagtgattcatcaactgccttcacaaacgcatgtcccctcttccgaaatgagggcggcgtcaaataccatgcagcccgcttcatcgtattcatatccttcaccatataaaaaacaagaaaagggatgagcgctgcaactaatgcgtaatcaagtattactttacagctaagaatcatccgctccgcgccgttcgctgcatatgtctccgattgaacaattaagcggtccaagcggtcgtgaagtccgtctggccaatggcttgtatgatgatgaatatgtgataaagcgccattatacgtttccgcaagcacaggaatttgttctgacagctcatttaactgcttgatcatgacaggcgcccctttataaaccgcaagcccaatccctccaaaaaacaggacataaatcaataagagacttagagtccttggtaagcccctcgagtgcagtttttccactatcggataaagcagataagaaataaaaatagcaatgagcagcggaatcagaactgcctttaacaacaaaaaaataggcatccataactcgtcgagctgcaataaaatgagcaaggatgcaaggacaagcagaacccctgcagcatatatcagaaattggatcggacgtttcttcacctttttcacctcttttcttattgtttaaccatcttctgcaattatccatgtaaataaaatttgtcctaactttgttaaaaatgaatacacatgaaacatacagcaccatccaaagttactaaaatgtctccactgaattccaccatgtacaagaggaggttcttcatgatcacattcgaagaagtcaataagcattatggccagttccatgtactgaaagacattaacctacatattcaaaaaggtgaggtcgtcgtgatcatcggtccttcaggatcaggtaaaagcacgatgctcagatgcatcaatcgtcttgaaagcattgatgagggaaaggtgcttgtcaacgaagtgcctgttcagcatccgaaaaccaatatcaatcttgtcaggcaaaatatcgggatggtatttcagcattttcatctctatccgcataagacggtgcttgaaaacattatgcttgcgccaatgaaggtgaaaaaggtgagcaaggaagaagcgagggaaacagccgaattttatttacataaagtcggtattcctgataaagctgacgcctacccttcaaaactctcaggcggacagcagcagcgtgttgccattgcaagagggcttgcgatgaaaccggaggtcatgctgttcgacgaaccgacatcagctcttgacccagagatgatcggtgaggtactagatgtgatgaagcagctcgcacgagaaggaatgaccatggttgtcgtcacacatgagatgggatttgcaagagaagtggctgaccgtattgtctttattgatgaaggcagagttcttgaagaatcaacaccggctgcattttatgagaaaccgcgtgagaaacgcgctcagctctttctaagccgtattttaaatcactagggggaatgattttaatgaaaaaaatgaaacgctttggcctactactctttatgacttgctgtattgccgcattagcagcttgcggatctgctgaaaaaggctcgactgatgcaaaaaaaggaagctctttagaaaccattcagaaagacaaaaaaatcatattcggggtcaagaatgatacacgtctcttcggtctaaaaaatcctagcagcggagatattgaggggtttgatatcgatattgcaaaagccatcgcaaaggaaatgctcggtgatgaaggaaaagcagaattcaaagaagtgacatcaaaaacgagaattcctctactgcaaaaaggagatattcatgcaatcgtcgcaaccatgacgattaccgaagagcgtaaaaaagaagtcaatttctcagatgtttattttgaagcaggacaatcactgcttgtgaaaaaaggaagcgacattcaatcaattgatgatttgaagaaagggacgaaagtgcttgcagtgaaagggtctacttcttctcaaaatatccgcgaaaaagcacctgaagcgtctgtattagaatttgagaactatcaggaagcttttacagctttaaaatcaaaccaagggcaagtgctgacaactgataatgcgatcttatttggtatggcagatgaggattcaaattacgaagtcgtcggcggcacctttacagatgagccttatggcattgctgtcaagaaaggggataaggaattaacaacggccattaataaagccctaaagacattaaaagacaatggggagtatgacaagattcatcaaaaatggatcaaagaataatgggttgacttgttaagaatgattttctcagggtgagccgctcattggctcccctgttgatcaggaaggaagtgaactgattgctgcggttttccattctcactgaaaacttcaatctttatgtagaaggctttaaatataccattggcgcaagtgtcattgctttgattggaagctttttgatcggtacactcatcgccattatgagaattgcgccactcaggccgctcaactggttaggaacggcttacgtggaatttattcggaatattccgttattattgattacatttgtctttttctttgggttacccgtgctaggtattgtagcagatggcttcaccgctggcacaattgctcttgccatttatacttctgcctttattgctgaagccattcgcgcagggatacaagctgtaccgcttggacaaatggaagcagcccgtgcttcaggtctatcctatagcgggacaatgcggtatatcattctgccgcaagcgattaaaattgtcattccccctcttgggaatcaatttattaaccttgtcaaaaactcctctattttaggagtcattgcagggtttgacctcatgtatcaaggagacctcatcgcttctagaacatttgtgacatttgatgtctacatctttgttgccatgttctatctgctattaacgattccgctcagtttaggcgttggttatttggaaaaaagattagcaagaagccactgaaaggaggacacattatggattttcttggtgcctaccagcctgatcatctcgcctttttacttgaaggatttgctgtcaccttaaaagtggcttttatctccatcattttgagctttctcattggattagtcattggcacgttgcggttcgctcaaattccggttttatcaaagatacttgcagtcgtcgtcgaaaccattcgaaacttgccgctcttattgatcatctttttcacctattttgcactgcccgaaattggcattaagctgagcattacagcctcggctatcgcagctttaaccgtatttgaatcagcaatgctgtcagaaatcattcgaagcggtttaaaatcaattgataaggggcagattgaagcagccagatcttctggtttaacttatatccaaacgttaaaaatgattattatgccgcaggctttacgccgaatggtgccgccaattgtcagtcaattcatctctcttttaaaagatacgtcactagctgttgtcattgctcttccagaactactgcaccacgctcaaatattaaacggtcagagccaatcttacttactgcccattttcctattagcggcaatgatgtattttgtcgtcaatttcagcctatcattactggcgcgccgattagaatataggcaggcataaaaaaggacatccgcttttggcacttagcggatgtctttttgtttacatcattctcataacgcgttttcttagctttttcatatcccgctttgatggcatatcatatcggcttgcaaagtgatatgcgagtgcgcctgcaccaagcgttaatagtgaagaagtcattttacccattcgaaattcccccttaacacttatagttgaattgaacgttcatcatcactaaacagatcatctaagctgcttagtgttccgtcttcttccacttggtgtgtagatattttgccttttgacagcgtcaattcaataaaacagccccagcaataatattgattgaccccaatttttccgatgtctttacatttgcaatttgggcaaatgagcataatcagcacctctttacgttcggtttagaacaagtgcttccttttgaacgttgatcaaggttccggcagcctgaagctgttttcgaatccctgatagctctgtaaagaagccgtccgagagttcatatgctacgattgtgcccgaatttgtgcaaaagtatacatcttccaaaatgcctaaattttcaccgtcaggcgactgcatcattttcttttttaatttcgaaaataagagggatggggcggaggaatccatgcctactccctcatggcagttcacatataagcctttgtctgtcagctgatccccagccgagaatggaacgagtgcacagtctttctttttcccatctaacacatatcctccgcagctgcctccggctaataagcaaatatcttttatggaaccaagtgaatgagacgtttcaccagtatagattgacattccttcaagctctcgacatgttctcaaaatgtgctcaaccaccttttgcggaacagtcttatcgtgtgcgtttgcttcaagactcatacgaagaaatggcttccatgaacgaaatatgcgaatttcttttcatgctaaaaaaggcttccacatctggaagccttttattcatgcataaaatcaaatggagtgattccctccataccgatatttgcatcatgcacgctaaatggcagttctttttgaagtgctgcaagctccgcatccatgacctctcctgtttgcacgagccgcatcgttaaggacgtttgtctgagcgaatcctcattgtttttcacgccccactccagtgctgattcctcgccgcacaggattaaaaactttttacttcgtgtaatggctgtgtacagcagatttcgccgaagcattctgtagtagcttctcaagactggcagtacaacaatgggaaattcactaccttgtgatttatggatggagcagcaataggcatgtgtaaattgatgaaaatcctttttagtaaaagtgatttcattcccatcaaaggagatcacagccatatcttctttttccgtgttttctttcgcataaaaaatcgagacaatttctccaatatcaccgttaaaaatattgttctccggctgattcacaagctgaagcactttatctccggtccggtacaccacatcaccaaacgggatttctctgccctttggttttttaggattcaaaatgtgctgcagcattttattgagctcattaatgcctgcttttcctttatacatgggcgcaagcacctgaatgtctttagctgaatagcctttttgagcagcattgctgacgactttctcaatgacttctttcatttgatcagctgagcattttatgaaggatcggtcttttgaacgtgcggtaatatcttttggcaggacgccatttttcatatcatgtgcaagttcaacaatgctggagccgtctgcctgccggtaaatatctgtgagggtaacagctggtacggcttgtgatgcaatcaagtctcttaacacttggcctggtccgacagacggaagctgatgttcatctcccaccatgatcacttggatatggtcaggaatggctttaaacaagtgattcgcaagccaaatatctagcatacttgattcatcaatgatgacaagctttccttcaatcggctgttcttcatcatgcgagaagccctctgatccgttccaaccaagcagccggtgaatcgtcacagctggaagccctgttgattctgtcattcgtttagctgctcgtccagttggcgccgcaagcacaaatggaaaggattcatcttttttgtaatcactcggatcaagagatacaccgtgaaggtcgctgtaaagctcaacaatgcctttaatgacagttgttttcccagtcccaggtccgcctgttaaaagcagcattggggacatgagtgccttttgaatcgcttccttttgtgtcggcgcatactggacgcccagccgttcctcgagctcaccaagggctagaaggaattctgattcaggaaattgatctgcatattccgtttgggagacgattttttgtatacgtttggcgacactttgctcggcataaaataaggacggatgatagcagcgctcatcttcaatgatcatctctttcccttcgccaagtgcaaggatctgattggcgacgtccatttccgtcactttgtactcattgcctgtctgattgagtagcttgcgggtttcgacgatcaaatcctttgtttgtatgtacgtgtgaccgtcctgaagactggctgtctccactgtataaagcaaggctgcacggatccgctctgggtcacttcctgagatgccagttctagcgccaagttcatctgccttaataaaaccgatcccttcgacatccttgacaagctgatacgggttttcttcaatcttctgcagcgtctcactctcgtacacttgataaatcttcatgctgagctgcggaccaaagccgtattgattgaggctgatcataatttgttccaatccttgatgctcctgaagcgctgcggccagcttatctgccttcttttttgataagcgcggaacgtcatacaaaaccgctgggtcacgcataattttatgaagcgtctgactgccaagctgtcctacaatttcttccgccgtctttttgcctatcccctcaaataaatcacttgagagataatgaataattccttgctttgttgtcggtacttctttttgaaaatgagttgcctgaaactgttcaccaaacttcgggtggcttgtgactttgccatagaaggtgtaagtttcttcctcatgaagtgctgggaagtagcctgtgacagatgctgttttttcctctaagttttccgatgtttcaatgactttcacctttaacaccgagtataaattactttcattatggaaaataacggcttgaactgttccctttaaaaacggttcgtcctcaagcttcatttgatctggatgttcctgcacaggtcttccctccttccgtctattctgcttcttgaatcaacttttgcgcatgcagtgccagcatatggtcaggctgcacatcaatcgcttttcctaacatctcaagtgcttcgtcttttttctctaagtatgcatacgcaacccctaaattataaaaggcatctgcatgctccggatcacgcgcaatcacctcagtaaaggttgtcaccgcttcttccagcaattgttcattggctaagcacatgccaaattggaatcttgcttcattatcatcttcattcagttcgatggcacgctgaagataaggcatcgcaagcttcggttgctctaatttgatgagcgtttgccccagcatataaaacaaatcactattttccatgcccgcttttagtgctttttcaaaatagtcttttgctttcataaagtcttcttttaatgtgtatacatttcctgccccgtaataggctgcagctgcagcgggatcaagttcaattgctttttgaaagaaatttaacgcacgttcaaattcattgatgcttgacagcaagttcgcaaagttaatatatggaactgggtctttcgggctttcttcaatggctttcgtaaaagcttccgctgctttttcgatgtttccctgatttaaggcttctatgccgatttcgttatgattcattcgctctctcatcctttcattaaaaaacctcaacagcgacgttgaggttttgaaaacatgttacacatacgacagtttttggccgtccttaaagacatcgtcaattgttccgccgcccaggcattcatcgccatcataaaagacaaccgcttgtcctggtgtcacagcacgaacaggttcatcaaagatgaccaatgcttcttgctcacctgtcattttaacctttacatggtgatcttcttgacgatatctgaatttagctgtgcatgttaattcaccgttttcaccgacaatatgaggacgagtccagctgatattgacggctgaaatgctttcagaatataaaagtggattgtggaaaccttgttcaacaaacaggatattttgttccaagtctttcccaacgacaaaccaaggatcaccgctgccgccaatgcctagaccttggcgctgcccgatcgtgtaatacatcagtccatcgtgctcccctttgacttctccgtccatcgtctgcatcacgccaggctgtgcaggcaaatattgactgaggaacgttttaaagtttctttctccaataaagcaaatacccgttgaatcttttttcgttgctgttgcgagctcggcttcttttgccaattcacgaaccctttttttctctaaatcaccgattgggaacatgactttatcaagctgttcctgagtcagctgatttaagaaatacgtctggtctttgttggcatcaagacctcttagcattttgacttcatcgccagttctgtcaacgcgcgcatagtgacctgttgctaaataatccgcaccgagtgacaatgcatgctcaaggaacgctttgaacttaatttctttgttacacatgacatctgggtttggcgttctgcccgctttatattcatcaaggaaatattgaaacactttgtcccaatattgcttctcgaaattcactgcataataagggattccaatttggttacacacgcggatgacatcctcataatcctccgttgctgtacatacaccattttcatctgtgtcatcccagtttttcataaatatgccgattacatcatagccttgctcttttagcataagagcggcaactgatgaatcgactcctccggacataccgaccacaactcttgtgtcttctggtctttttgtcatcttcatcaactccattttcaatgaaacagcatgtgcgtttcgttcttcaggtgcttggctgtttcatttttcacacacgaacaaaagaggaacgtttatttggctaagcgtttgacaacagctgctatcttacgtgccgcctgcttcacatgatcctcttcattcccaagaccgaagcttattctgactgaggacgtcagcttgtctgcttcttcgccatacatggcgcttaacacgtgcgaaggaaggacggatccagccgtacatgcagatccacttgaaacagcaattccttccatatctaaattcacaagtaacgattcgatggaaacgcccgggaaatgaacatttaaaatatgtggcaatgtctctttcgggtgtccattgatagagaaagtaagtgattcctcttcgaatacttgcagcatgatttctttgagcttaccataatgcatggctttttctcttctattttgcttcgttaattgaacagcttctgcaagtcccacgatccctgccacattctcagtgccagcacggcgttttctttcttgttctcctccgaaaatttgcggagaaagtttcacaccttcgtttacatataaaaagccagttcccattggaccatttagcttatggccagaagcagataaaagatcaatatgaaggtctgctacatcgatcggcattgttccaaacgcctgcacggcgtcagtatgaaaatgagcagtgtgatggtgtaaaagctcgccaatgtctttgatgggctgaatcacacctgtttcattgttgccgtacatgatggtgacaagaatcgtatcatctcttagtgcttgctttagttgttcaagatgaatcaatcccgtttcatccacatctaaatatgtcacatcaaatcctagcttctctaggcgttcacatgtatgcagcactgcatgatgctctgtttttgctgtgatgatatgttttccttcatgctgccttgccatcgccacacctgtaatggccaagttgtctgcctctgttcctccgcttgtgaggatgatctcctgcggtttacagtgtaattctcctgcaatgacttcccttgcttcatcgagccactttcttgcctcacgcccgtatgaatgaatactagagggattgccaaatatctctgtaaagtaaggcatcatcttgtccacaatccgctgatccataggcgttgtcgctgcatgatctaaatagatacgttccatttccggtacacctctgatctaaatatagaacatatacgcctcttgatcctcgtcatctttatagcttgccaagtcttcaagagttgtattgtctagtacgtcttttactgcatcacgaatacgaatccaaagtgcacgttttgctggttcttcgttttcgatgacttcgacaggactaatcggtccttctaatacacgaataatatcacccgctgttatcgcgcttggctcatgggcaagcacataaccgccatatgctccgcggatacttttcacaagacgggcattgcgaagtggtgatacaagctgctctaaataatgctcagacaaattattgttttgagcaattgattttaatgatgtagggccttcgccatgttttttggctaattcgatcatgatcgtcagaccatatctgcctttagtagaaattttcaagttaaacacctctgcgttttctatttctatgtcatcaattatttttctgatttcatatacgcttatatagaccaaaagcaattatatcatacttttagccaactttcatttgcgggttctgagctcaaaatgaggacgcttcccttttctatttgaagaaatttcggtactctatacaaacaagacattgctttaggagagataatcatgaaacctttagcgtatcggatgcgcccaagtcatattgaagacatcattgggcaggagcatctcgttggagaaggtcaaattattagacgaatggtcgaggcaaaacatttatcctcgatgattttatacggaccgccgggcatcggcaaaacatcgattgcgacggcgatcgctggcagtacaagcattgcgtttcggacgttgaatgcggtcattcataacaaaaaggatatggaagctgtcgccgctgaagcgaaaatgagcggccaggtcatcctcattttagacgaggttcacaggcttgataaaggaaagcaggatttccttcttccttatttagaaaatggcatgatcattttaattggtgcaacgacggctaacccctatcatgcgatcaaccccgccatccgaagccgaacacaaatatttgagctaaaaccgcttgaaacggagcaaatcaaagctgcgctaacaagagcgttacaggatgaacatcgcggacttggcggttatgaggtgacagtggacgatgaagcgatgaatcattttgccaatggatgcggcggagacgtacgctctgctttaaatgcgttagaactagctgtcttatcgacaaaagcagatggggctgggcatataatgatcactcttgccgcagcagaagaatgtttacaaaaaaagagcttctcacatgataagaatggtgatgctcattatgatgtcctctcggcttttcaaaaatccattagaggatctgacgcagatgcggcgctacattaccttgccagactaattgaagcaggagaccttgaaagcatttcaaggagattactcgtgatggcttacgaagatattggcttagctagtccgcaggcaggccctcgtgtgttaagcgctgttcaaacagcagaaagagtcggcttcccggaagcacgaattccgctggccaacgcagtcattgagctgtgtctttctcctaagtccaactcagcgtataaggcgatcgatgcggcactaggtgacattcgttcagggaaaattggtgaaatccctgttcatttaaaggatgctcactataaaggagctaccgctctcggcagaggtgtggattacttataccctcacgattatgaaaacggctgggtgaagcagcagtacttacctgatccgctgaaaaacaagcaatactatgaaccgaagcaaacaggtaaatttgaaggcgcactaaaacaagtatatgagaatttaaaacgccaaaaataaaaaaagccccctgcgtaatagcaggtgggctgtcagattgttgacaaagggctaaaatgatcttgattttagccctttgtcttcttttcagcgtgatagaaaacctttgcagtctaggaaggacgagcatcggagcggagcgaatttaacattcgtgagcaccgaagcgcagatctgacaccgaatgcgagggttggtctacacgctggcccctgcgtaatagcaggtgggctgtttatttatccttcacacgtgtaattggaatatctttcaaaagctgcataatgacatgaccacccatgatcagtcctgcaacagacgggacgaaggcattggatgatggcggcatttgtgccttgcgaatcttcgcttcatcatttccaacttcttttctaacatcttcgcgaatcacaatcggactttcatcagagaaaatgacttcaattcctttacgaatcccttctttgcgcagacgcgttcttacgacttttgcaattggatcggtatgtgtttttgaaatgtcatcaattttgaagcgggtcggatctgttttgtttgcagctcccatactcgaaatgatgttcacgttgcgttttagacactctttcattaaatgaattttatagtgaatcgtatctgacgcatcgatgacataatcaagtggatattcaaaaaattgctcataggtttcctctgtataaaacatcttgagcgcaacaacttcacattctggattaatatcagcgattctcgcctgcattaagtcaacctttggttgtccaactgttgaaagcaaggctggcagctgacggtttacatttgtaatatcaatatcatctttatcaacaagaacaatacggccaacgcctgaacgagcgagtgcctcaactgcaaatgaaccaacgccgcccacaccaagcactgcaactgtactgttttttaatatatctaagccttccttgccaatggcaagctcgtttcttgaaaactgatgtaacaagtgcctcactccacctttatttaaaatgaatcgaaagaatcatatcatattcaaccttcttcgtcatccttctgaaaaagaaaaaaacacaaaaaagtcccgacaacgccgccagcttttccttcgttttgaaccccgcaccatgcaggtgggtgctttcttcctgactttataagtcctcaaaagaggcatttatgcagaaaggaaaggcaagctcccgtataaaaaaatgttcggtcaaaactaggtaaccaccgtacgtatcaggactttatttattgattgaagaaagcatatcataggcatgccgctttttcaagcgtttacatgcctatatccatgcgtctattttactgttttacttttgttttaatggctaaacttaactcatccagctgcgactcgctcacatgacctggtgcatctgttagcacgcagctcgcacttgctgttttcggaaatgcaatcgtgtctcttaagttagagcggccggcaagcagcatcactaagcggtcaagaccaagtgcgattccgccgtgcggaggaacaccatgctcaaaagcatctagaaggaagccgaattgttcataagcctcttcttttgaaaacccaagtaagctaaacattttttcttgaatgtccttttcgaaaatacgaatcgaacctccaccaagctcatagccatttaggacaagatcgtaagcctgtgctttcatgtcttctggacttgtctcaattaattcaagatcgtcgcgcactggcattgtgaaaggatgatgggcagcatagaagcggccttcttcttcatctttttcaagcagcggccaatcaacaacccataagaagttgaaaagagactcatcgatgagcccaagctctttaccgagttttaggcgaagggcaccaagtgcgtcatggacaacagacgtcttatctgcaacaaaaagtagaaggtcgccttcttcaacttgcagctcttcttttaattctgcttgctttgcttcgtcaaagaatttagcaatcggtccttttaattctgccccttctgctttaagccaagctagaccttttgcaccgtagttcgctgcaaatgcaccaagggcatcaatgtcttttcttgagtagttcgctgctgctcctttgacattgatggctttcacagctccaccatttttcacagctccgctaaagactttgaaatcagagtcttttaccgtgtctgagatgttaacaagcttcatctcaaaacgtgtatctggtttatcagaaccataagaattcatcgcttcatcatatgtcatacgaggtaatggcaatgtcagatctacacctttgacatctttcatcacctttgacatcatctcttcagcaagcgtcataatgtcctcttgactcataaaggacatttcgatatcgacttgtgtgaattccggctgacggtcagcacgcaagtcttcatccctaaagcagcgggcaatttgatagtaacgatccatgcctgagaccattagcaattgtttaaataattgcggggactgaggcaatgcatagaactctccttcgtgtacacggcttggaacaagatagtcacgtgcaccctctggcgtactttttgttaaaatcggtgtttcaatatctaggaagccgttgtcatctaggaaatggcggaatgctctagtgacttcatgtcgcattttcatcgtttcaaacatagcaggacggcgaaggtctaagtaacggtatttaaggcgcacatcttctgatacctcatccgcttgatctgaaatcacaaaaggaggagtctttgcttcatttaacacgctgaccgtttcgacttgtatttcaattttccctgtttttaaatttggattgattgttgcttcttctcttgccacaaccgttcctttaatatcaaggacatattcattacgaatcgattctgctgtctcaagcgcctcttttgaaaggtctggattgaaaacagcttgtacaattcctgtacggtcacgcagatcaataaagattaatccgccaaggtcacgtcttttttgaacccatccttttaatacaacggtttgaccgatttggtcttctgttacttctccacaataaaaagttctaccaaacacaaacattccactccttctttacgccttcttgtgggccttcatcatttgaatcagctcatcaagcttcacttcaatttgttcacccgttgtcgtatcttttacattcacaatgtgctgcgcgagctcatcttcacccaggacagcaataaacttggcttttaatcgatcagccgctttaaattgtccttttaatttcttccctgtatagtccatttcacttgaaatgccttcttttctcagacgatttaataatgaaacagcgtaatctttcgcatcatcaccgagtgcagcaatgtatagatcaatgccatcttgcagtggaagatcaatcccttcagcatcgattgctgataggaagcgctcaatactcatagcaaaaccgattcctggtgattcaggaccgccaattccttcaacaagtccatcatatcggcctccgccggctaatgtggtaattgcaccaaagccttcagcattgctcatgatctcaaatgctgtgtgattgtagtaatcaagaccacgcactaagttcggatcgacgacatattcaacgcctatatctgttaagtattgtttgaccttttcaaaataagtccgtgattcatcatttaagtaatcttgaatggatggagctgttgccatcaattcgtggtcacgatcctttttacaatcaagaattcgaagcggattttgatgtaaacgagtttgacagtcatgacagaattcatcgattcttggttcaaagtgcttaacaagtgcctcgcggtagtctgcacggctctctttgtcaccaaggctgttaatgacgagctttaagttagaaagacctgctttctcataaacactcatcgcaagggatatcacttctgcatcaatggctggatcctttgaaccgatcgcttcaattccaaactgataaaattgacgatatcttcccgtttgcggtcgttcatagcggaacatcggtccgatgtaatacagctttgtcggctgcgcgggctgtgcaaataatttattttcaacataagaacgtacggttgatgccgttccctctggacgaagggtgatgctgcgtccctttttatcttcaaatgtatacatctctttttgaacgatatcggttgattcgcctactccccgtgcaaacagctctgtatgctcaaaaatcggtgtgcggatttctttgtattgaaaggctgcacatgtatctcttgcaatttgttcaacatactgccagcgttctgactctccaggtaaaatatcctgtgtgcctcttggaatattaaaactcatttttcgtcctcctacgaccatcattcattttttatgtggacatataaaaaacccccgcctctactatgtgtatagtagggacgagagttatacccgtggtgccaccctagttggaacataatctagccatgttcccgctcaaatccttaacgcagattcacgttctccgcctattgactcatttttagagcgttcagcaggaaacctacagagtgttctttcgtgataaatgccatgcggattcgctttcagcctaaggcgattcctctctgctcacgcaatttaccctactattctctatcatcagttccacattttaaattttcaagtgtgttgatttatattataataaggtcggtgctgccactctgtcaacccttgccgtgcctctttttcttttccagctcttcttttgacgtacatccgtattcagatgcggtttcttctaagaagcctggttgatccatttcgtcgtgctgccagcgatcgatatcacgatgtccattatattgcactcgtcctaattttctgcttaatctcatgtttgtacatccttttatcacgtttttatttagtataaacagattgattcatttttattaggaaactgcaaggaattagtccattacataacgaatttacattcatcggttttacaagggaggggaaaacaccgttttgaatctaaaaaaacacaatcaaatcatgatgcttcttacctgttttgttctcatcgcaagtactttgcctatgacacatgctacagcacaaacagatcaagctgtggtcgctacagatgaaatcaatgtgagaacaggtcctggcttaagctatggaatcgcagctgttgtgaagcgcggagaaagctatcctattctcacgaaacaaggagaatgggtgcagatcgggctatcgaacggccaaaaaggctgggtcgtctcatggctgattacaacatcatctagcgaccaaaagtctgctaagccaaagacgcaaaatcaaagctcagcagagagcagttccattacatcgacagcctctgatcttcgcatacggacaggccctgggacgtcctatcaagtcgtcggaactttcccgcaaggcgcttccgctaaaaagctgcagacaagcggcgaatggacaaaaatttcgtataaacaagcagtaggctgggttcactctgattatgtgtcaggcggccaaaaagcttctcaatcaagcgctggcgagtcctctcgctctaaacagacaggcacagttggcgtatcaagcttaaatgtaaggcaatcggcggcacctaatgcacaagtcgtcgcttcacttgcccgcaacacacagatcaccattttgcgcgagcagaacggctggtatgaaattgaggcaaaaggcgtgaaaggctgggcagcaagctattatatcgtcacaagcaatggagcgagttcggcgggtgaaaagaattcatcttcttcggcttcccaaaagaaagcgtacattgtctacgatggcaccaacattcgaaaaagcgcttctacctctgctcagattgcagaaagagccacaaaaggcgctgcctatcaaattgttcgcacgcaaggtgactggtacgaggtgacattatcaaacggcggaactggttatgtggcaagctgggtcgttcaaacgaataaaaatagcagcgaggcaccaagaccacagcaggattcatcgtcaggaactggttctttaaaaggaaaaacgattgttcttgatccaggtcatggcggaaaagacagcggcacgattggcgcagatggagcctttgagaagaacattaccatcaaaaccgccaatttactggcaagcaaattaagggcttctggagcaaatgtttatttaacaagaagtgaagatacttttatcagccttcaatcgagggtcgcgacatctcattacagaaatgcagatgcatttattagtcttcattatgatagttttatggacccaagcgtcagaggaagtacagcgtattattatcaagcagcaaaagaccagcaattagcgacaaatgttcatacagaagttgctaaacgctctcaaatccctgataagggtgtcaaattcggagattattttgtgttaagagaaaacaaacgtccttctcttttatatgaactcggctatttaagcaatcctcaggaggaagccatcatttatagcgcctcttaccaagaacgagtcacagaaggaatgacagaaggattaaaacaatatttccgctaaaagaaagaggccactgtgcctcttttttgtttgattgcaaaagaaaaagactctaaacaaactcctgcaagagtctatctacagtctaaattgaatctattctttactatccatccagatggtgacaggccctgagttggtcaatgacacatccatcatcgcgccaaagcggccagtttctacatgaatacctttttctctaagggctttattgaaacattcgtaaagggcgttcgcagcatctggcttggctgctttcataaaatttggccttctgccctttcttgtatcaccataaagggtaaactgagatacagacagcacgcttccttttacatccaataacgaatgattcattttcccgttttcatcttcaaaaatacgtaaatgtgcaagcttatcagctaaataatgcacatcttcttctgtatcttcgtgtgtgacaccaacaagtaccatatatccttcattgatggcacctgtgatctcttcttctaccttcacagatgcacttgtcacacgctgcacaacaagcctcatagacgatatacttcctttctaattcatgaatcggcgaacagagtaaatgtctttgatttgtttaatgcgttctaccactttgtgcaaatggttaatattttggataaagatcgccatatggatcgtcgccactttgttacgatcagacttaccagaaaccgacgagatgttcgttttggtttcgttgactgcttgaagcacctcattaagtaagccgcgtctgtcatatcctaatatttcaatttccacattgtattctttacggtttcgagcaggctgttcatgctcccactcaaccgggattaaacgttcctgcgcttctcctgtcttcacgttcggacagtcatcacggtgaacagatacgcctcggcctttcgtaataaaaccaacaatgctatcacctggaacaggattacagcacttagataagcggacaagcaggttatctatccctttgactcttacccctgcttctcgtttcttcccgtgatatgtctttggctctacagtcacttcttgaaccgttttttcttgttcttcttgatctctttgttttctttctttttcagttaaacgattggcgacttggagtgcagtaattccgttataaccaaccgctgcatacatgtcctcttcgtttgaaaaattaaatttgtcagccactttttgcaagttttcagctgtcagaatgtctttgacatcaaactcaagatttttgatttctttctccacgagttctcggcctttttcgacattttcttcacggcgctgttttttgaaaaactgtctgatcttgtgcttcgcttgggaggtttgggcaagtttgacccaatcctgacttggcccatagctgtgctttgatgtcagaatttcaataatgtcacctgttttcaatttatgatcgagcgtgaccatctttccgttgaccttcgcaccgatcgttttgttcccgatttccgaatgaatccggtaagaaaagtcaatcggaacggaacccgatggcagttcaatgacatctccttttggtgtaaagacaaacaccatatcagagaagagatcaatttttaacgattccataaattcttctgcatctgtcgattcattttggaattcaaggatttctctaaaccaagagagcttcttctggaaaacagcttcctccgttgattctgctgactcttttccttctttatatgcccagtgcgcagcaattccgtactctgcgatttcatgcatttccactgtacggatctgaacttcaagcgggtcaccttttggtccaatcactgttgtatgaagcgattggtacatgttcggctttggcattgcaatataatccttaaacctgcctggcatcggcttccagcaagtatggataatcccaagcacggcatagcagtctttaatgctgtcaaccaaaatacggacggccagcagatcataaatttcattaaactgcttattttgcaggaccattttgcgataaatactataaatatgctttggtcttccggaaaattcagccttgatgtttacctctgacacacgatcttttacttcattgacaacctcgtccaagtattcctcacgttccgctcgtttacgcttcatgagattcacgatccggtaatattgctgcggatttaagtaacggagcgctgtatcttcaagctcccacttaatctttgaaatccctaatctgtgcgcaagcggtgcaaagatttcaagggtttcatttgaaattctacgctgcttttcctgcggaaggtgtttgagcgttctcatattgtgcagacggtctgccagtttaatcaagatgacgcgtatatcctgcgccattgccacaaacatttttcgatggttttcggcctgctgttcttcttgtgatttatatttaatcttcccgagctttgttacaccatcaacaagcatcgcaacttcttcgttaaaatgctcttttaaatcctgtaatgtcacatctgtatcctcgacaacatcgtgcaggaaaccgcctgcaatggttgatgggtccatttcaaggtcaacaagaatccccgccacttgaattggatggataatataaggctcaccagatttccggtattgctccttatgtgcattttcagcatattcatatgctcgctctataaattgaatatgttcagcggacaggtattctcttgccttgtcaatgacctgctgcgccgttaaaacttgttcgttcgccatggaatcacctttttaaatgaaaactgtattgtagtttattatcaagaaaaattcgatagatgtaaagagaagaagtccgctaaaagatttttgataggaaaaaagcacccttcttaccgagtgctttttgcgtaaaactccattagtattgcattaacgtcaagatgtcgtaaccgtcaagcttctttctgccgtccaggtacgttagctcaatcaagaatgcaattcctgccacaacgccgcccaattcctctacaagcttaatggacgcttcgattgttccaccagttgcaagtaagtcatctgtaatcaatacacgctgaccaggacgaatcgcatctttatgaatcgttaatacatctttcccatattctaagccgtattcgactttaacgacttcacgaggaagctttccttctttacgaaccggtgcaaaacctacaccaagtgcgtatgctacaggacagccaataatgaatccacgcgcttcaggtccaacaataagatcaatgtctctttccttcgcgtattcaacgatttgatccgttgcataacggtacacttcgcctttatccattaacgttgtaatatctttaaattgtacaccttcctttgggtagtcaggtacaactgtcacatattgttttaaatccatcttttccttttcctcctcgtacgtcaaagcacaggtgagacttcgctcatcatgctattcagccattccttcagctctttggctgaggaatatgttagtgtttgatcgagttccatcaatcgttgttttgctgtataggatgctgatgccgttaaatcttttttaggggcatcacgtactattgacagcacaccattctctattttaacaaaaccgagttcaaaaaacacctttgtcataaaaatcattgtatcttttgtccagcctctatgtttcgcaagctccattccttgttccttgagagggaaacttcctcgttttaacaagaatccataaaaccatttgaattgatcacggctagggaaagaggacatgaaatgatcttcttttctttggaaaactgtatacactctagctggcttttgattttctaacagctgccttagcaactgttcatctgcagggacatctgcaaagacgacatacttgccttcaacatcgagtgttgaaacattttctgcatggacatgatgaatcgggatgctgacttcctcttttgtttcttcgtcaaaacagaccaccacatatttttcggggtcaagcgtggagattgtcttttcccaatcctttttgccgcgcaaatcaaacagctgccattcatctactcgggcatcttttagcatgagctgtggtttcttccggttattccattcattgatggacatttcaccaatgacggaaatccggctacctgtgacaatttcttctttcaattgaccttgatgaaaaccgacacagtcaagcagtttgtcttcatctttcagagacattttgatatgattttgatttgctccaatggttcggatttcttcaagtctcgcatcttcaatcatgatgaacggctttggattctgcatgccaaatggtgacagcatccccacttcttcaatcgcttcaaccgtcaattcgtctaccttgcatacagcatcgacccgctgaatcggaataaagtcttcctctgtcaacgtttcattcgcatattgatttaatctttcccttagtaaagggacatcatccgctcgaagtgtcatgcccgcagccatcgggtgcccgccgaaatgcggcagaatgtcgcggcatttgcttaaatggaaaaatagatcgaagccgggaatactccgtgctgaaccttttgccatttgcgtctcttcatctattccaagcacaattgccggacgagaaaatgtatccgtcaatttagaggcaacaattccaacaacacccggattccagccagctttcgctacaacaatggcagactggtcatcacctgtctcttccaccatttgaatggcttcttctgtgatcgtactcacaattttttgacgttctttattcagttcttgtacaaaacgagcgagttcttctgcttcatccttctcctctgtcatgagaagatgaacagctggatctgcctgttcaattcgtcctacagcattcagccttggcgcaatttgaaagccgaccgtttcctcatttgcttcttcaagagtagcacctgcttctttcaataacgccttcagtcccggtctattcgactgccgaagctgcataagcccttttttagcgagccatctattctcatcatgaagcggcacaagatccgctattgtcccaattgccgcaagatctaacagctgagctggcagcttaccaagaagagcatgagccactttaaatgctacgcctacaccggcaagttctttaaagggatactcacagcctggctgcttaggatggacaatcgcaagtgcttcaggcagctcttcgcttggttcatggtgatctgtaatgatcaagtctaaccctatttcttttgcaatacgcgcttcatttacagctgcaatgcctgtatcgacggtgatgacaagcgatgcgccttgctctttgatatatcgaaaagcctgttcattaggcccgtagccttctttaaatcgatctggaatataaaagtctactttcgcagacaactcttttaatgtatgtaaaagcacagacgtacttgtcacaccatccgcatcatagtctccgaagatcacaatcgattcctgctgttcgatcgcttggttgatgcgctctactgcttctttcattccttttaatagaaatggatcatgaaattcagctttttgatcaaataaaaaagacctcgcttcttctacttcttcgagtcctctttttacaagaagcgatgcagtcagcgctgaaatattcagattttcagagagtgatttcactttttcttcgcttggatgttcatattcccagcgcattttggataataacataaattcacccctcaaccacactattatactagagtggcctgaggggtttcaatttttattttatgaaattgtgctggaagattatttttccttccgatcaaatgatgctggctgttcttttaaaggcgtcacattcggtttcttttgaacgtctttgtcgatctttttattcgaaacagcaggtgcaggtgcggttgcacgctcagcttttaaagcctttagttcacgttttagtttcacaatttggaaaatccctgcaaaagccacaatgagtccgcccatgagcacagaaccaataatgacaaggatgagcggccattcagccgatccaaataagtagtcaacttgcactggccgcacattgatcacggcaaatactgagacaattaatacgaaaataaatgcgagtatgatggtccattgttgtttgttcatctacatatcccccaagctttttcttttattcttcccttttcattgtcctttttaaacccagaaagaaaaagcggaagaaaatctatcagcatgggcatgaattagctgctgagtttttctttaatgaggttctttatttcttgtctttctccagaaataacaagggtatccccttcttcaatgaccgtttcaggtcctggatttaacattttctcatgtgatttcctcacgatagcgatgactgttacttgatagttttggcggacattgaggtctccgatggtttgctgaatagctggtgcattcttctcaatcttaaaccattcaatcatcagttcatcaatggctacttcaacagtttcaagcgctttcggcttatataccatgccgcctaagattgctgcaatttgtcttgcttcttcatcgtttagcaagataccagaaatagattcttcatgatcgtcctcttgaaaatgatacatttctctcctgccgtcatcgtgtgtaatgatggctagcttttcattatttcttgtgatcatttcgactttgtgaccgatacctggcagttcagtttcccgaaccttcataacagcccctccaatgaataaagccaaatgcctcaaacggacacttgctttctatactgatctaaacgtatgtcattatagcaaaagactatttcaagatcaatgatacccgaaatgtttttttgaatcgacttattctcgggaaatctattgaaaaaagactgccaaaaaggcagcctttctcaattaaatatcttgctcagtatcaatcttcgccggctttttcagctcacggcctttccacatgagccaaatttgcgctgcgatatatagagatgagtacacccctgttaacagaccgacaagtaaggcgagggagaagtttgtaatcgatgccgatccgaagataagcagtgcgatcacaacaattacgacagtgagtaccgtattgatagatcgtgtaaaggtttgctgtaaactcaagttaacgatgtaagatagatcttctaccgtttttggtttacgtttcttcatttgctcacgaaccctatcgaacgtcacgatcgtgtcattgatcgaatacccgatcaccgtgaggatcgccgcaatgaaggtcacatctacctctaatcgtgtgatactaaagaatgccacaatgaagaatgcatcatataaaagggaggcaatcgctgcaatggccattttatattcaaaacgaatggaaacataaataatgatcccaatcgaagcaatgatgatggcatatatagcattacgtgcaagttcttttcctacagtaggagacaccgtgctgacattcggttctgttccatacttatctttaaagtaatctttcacttctgcaattttttctttatttggcacaccaacaaatcgtgccgctgcttgattttctttttggccagataacacaacactatctgtatccagatctaatttttgaaagtcttgctcgatttgagcagttgacagcttgtggtcactttgaatgtctactcttgtaccacttgcaaagtcaatacccgcattgagtttgaaaatcgaaaggacgataatccccgcaatggtaatggctactgagaaaatcatgaaaccttttcgcttgctgacaaaatcccatttatcaaatagtgtttttggttccgtattttctgttgtttcatgaatatcgatgatgtctttttgacgaacaccaaaccagcctttcttgcgatcaagcgctcggctttccacaagcagaccaagaaggaatcttgataggaatacagctgtaataaagcttgttaaaatggaaaggatcagcatcgtcgcaaacccttttacagaacttgtcccgaagaagaaaaggacgccccctgcaataatactcgttaagtttgcatcaaagatggtcgcaaatgatcggcggttccctgacctgaaagcagagcggacagatttaccgagcttaagctcctctttgattcgttcatatgtgatgatgttggcatcaaccgccatccctactccaagaatcagtgccgcaattccaggaagtgtcagaacagcccccatccagtcaaacacctgtaaggtaatatagatatacgttgataacgtaatgacagcaataagaccaggtattcggtaataaaaaagcatgaataagaaaatgagggcaattcccacaatccctgcaaagacagtttcatttaatgcctgttcaccgaattgcgcactcactgatgtggagtacttttcagttaatttcactggcaatgccccagcatttaaaatacttgcaaggtcttttgcctcttggacagtaaatttcccttcaatttgcacgtcactgctgttaatttcttgattcacattcggcgcagagacatacttgtggtttgattttgagacttcttttttgaaggaatctcctttgtggtaatcaagccaaatgacaagctggttattcggcgccatcgccgctacttttcttgtgacgtcaccaaattttttcgcatcctttagtttaaccgtcacaattggctcattcgtttgactgaatgtttgttttgcactgttttcgactaggtcagccccgtttaggagttctttatcattcgtatctctgaaggatagctgtgcttcagtggaaagtatctccctagctctgttttgatcttttaccccagcaagctgcacacggatacgattgttgccttcaatcgagatgttcggctcacttacacctagcacattggctcttcggtttaaagcctccaccgtactgacgaggacactatttgtaatcttgtcctcttttttcactggatgtacatcatacaggacttcaaatccaccctgtaaatccagccctagcgtcatatctttcgcaacaggctttgttagtaagcctacgccagttccgattaacagaaccactaagaaaaacgcaagaatgcgcccttttttcattatgtatttcctccttaaacacctgaatccattaagatggcttatttcaacagttcatctagcatattcttgccatcttcactgtccaaaaaagcagacgttttaaacgactgaacggttgcatagttcataaattcgccaattttcacagataaaatatctgcaaccatttcatgaatcggatactcttgttttttcttccacttcttattctctaagtatgaccataattcctctaaatctacatctttatagcccaaaacgatgaattcttcaagcttactgaacagaaaaggctttaaatggtctttgtaaattgcagccggatgttgtgtcaatgggatgctcccccttttcagtttttatcgagagacttgtcatgcttggacgatatacacgcatatcttattgtatatgattctatgtcgtttgagaaggcaggtgatctttgatttgacgaagcaaacgtttttaaaaggcacgattattttaattttagcaggttttatcacgagaatattgggttttgtcaaccgaattgtgattgcaaggttcattggcgaagaaggagtcgggctttatatgatggctgctcctaccttttttctcgctgtgacactgacacaattcggactgcctgtcgctattagcaagcttgtcgcagaagcagaagcccgtggagacaaacagaaaacaaaacgaattcttgtcatgtctcttgcgataacagggacactcagtttgatattcacgccgctctttttatggtttgcacccatcatggcagaaaatatgctgacagatcctagaacagtctatccactgcttgccattacgcccgttgtcccagtcatcgccatttctagtgtgctgagaggatattttcaaggcagacagcaaatgagcccgcttgccatttctcaagtgctggaacaggttgcaagaatttctctagtagccgtatgtacaacagcttttcttccttatggaattgaatatgcggcagcaggagcgatgatttcatctgtcattggagagatgatttcacttgcttatttactgattgcctttcgttataaaaagaccatccgtattcgaaaacgatttttcaaggcgattcatgacggtaaggacacgtttaagcagctgatgagtattgccctgccaacaacaggcagccgatttattggcaatatttcgtggtttttagagccgatagttgtcgcgcagagtcttgccattgctggatatgcggctgttgaggcgacaagacagtacggggaattgactggtcttgcgctgactcttttgacactgccaagcttcattacgtattcactctccacggcattagtcccggcgatcagtgaaggaatggagcagaacaaacgcaaaacggtcgaataccggctgaagcaggcaatgcgtctttgtctactcagcggaggtatttcctgtattattcttttcgtttacgcagaagatttaacgctctttatgtatggttcatcccatgcggctatttatgtgaaattcatggcaccattttttcttctatattattttcaagggccgcttcaagccgtcttgcaagcactcaatttggctggtgcggcgatgacgaatagtctgataggtgctgttgtgaaaacaggaatgatctttgttcttgcttcacagccgggctttggcattatgggggcagcacttgcgatactaatcggcatcgtccttgtcacgctgcttcatgcggcaactgtcggtaaagtactgcctattcatttaccaatgaaggaatatgggatatgtgttcttgtgatcatcggcactggggtggtgagcctttggctgaaatctcaaatgaacggattcttttctgccccgattgagctagtcatgctgatttttgtgacgtgcgcactgtatgtcattctattaatctgtctcggtctagtgaagaaagaagagctgcgccgcatcccgtttattgggaagctgctctagctcatctttttttgatcacttcatctttcaaatcaatataaaaagtcttttgattaaagctgcagtacgaaatctgctctatatcatgatagccccttttggtcagctcatctttcaaccattgttcattttgattaatttgcttcaggtgatcatgctgcacaaccccatctgcaataagtggcagctcaagcgcagcatgtgtgcgcttgttttctttttcaacgacggcgagctttccagatggctctaaaatggcgtaagagacatcctgaatgctatcgatgttgttttctcttaattgtatgagcaggtcatcaaaattgtatcgctgttttctcatcgcaccttcgtcgattttcccattgatgatgagcaggaccggtttgccgtccagaaagcgccggacaccttggaatttcaatgagaggtaggcaagtgtaatttgaatgaaggttaacagcagaatcggccataccgtatgtaacatatgatcctcgacttcttctatagcgagaaccgcaatttctgcgatcatcataaaaatgacaagatctaaaatgctcaattcgccaatttctctcttgcccattaaccgaaaaataaaccatataagaaaatataaaatgattgttctcatggagataatccagatatcctgcatgtgatgtaaaccctccttctctcacatagcttgtgtcaaaaccctttatttatgtagaaaagaaagcctctgcttttatcgtgagaaacatgtctattttttctttgcgttgaatacattttagtaaaagacaagcttcggtcaattggagaggagacgaatcacatgcaggaaacgaaacaaattggaaaagggattttatccggcttaatggccatttttatcgtcatgattgtcacaagcttacttgtatcgctcatgcttaccttcacaagtatgcaggaatcatcgtttaaatggatgattatgattttgtcctttgtggcacttttattaggagggatcatttctggaggaaaagcaaaggaacgcggctggctcattggtgcgatcacttcgctgatcttttctctcactgtatttttgtttcaatatttagggtttggagcaaccttttcaccagagcagttcatctatcatggggcatttttaggaatttgtatgctcggcgggatgattggcgtcaatcttcgaggcaaataaaaaaagagcggatctatatcgctcttttttttatggctatgtattggaggattagcctttgtcagctaattctctaatagcacgacgatcgaaagttaaacggttgttctcgctagttttgatgaccacttttgattcatcaatgtagtcgatttcaccgtgtaaaccaccgattgtgacgattttatcgccttttgataaagattgctgcatctgacgcacagctttttgttgcttttgctgtggacggattaataagaagtaaagcacagcaaacatgacaacaatcataatgattgaacccataccaccatccattctatttcacccctttctaatgcattgtaaagccttttcgtttatgcgttaaaagtttttcgcattcggttcgttaaagccgtaacgctcaaaaaactcttctttaaaatcacctaaacgatcctcacggatagcttctcttacttgctccattaattttaacagaaaatgaagattatgataagttgttaatcgaattccgaacgtttcatttgttttgattaaatgtctaatataagcgcgtgtgtagtttttacatgtgtagcagtcacaattttcatcgattggtctgaaatcacgctcatattttgcatttttcacaacaagacgtccttcgcttgtcatgagcgtaccgtttctggcaattcgcgttggcagcacgcagtcaaacatatctacaccgcgaattgcaccgtcaattaaggaatctggcgagccgacacccattaagtaccttggtttgtctgctggtaacaatggcgttgtgaactcaagtacacggttcatcacatcttttggttccccaacagataagccaccgatggcgtagcctgggaaatcaagtgacacgagatcttttgcactttgtttacgaagctcttcgtattctccgccttggatgattccaaacagcccttgatcctctggacgctgatgcgcttctagacagcgttctgcccatctgcttgtccgctctactgaacgtttcatgtaatcgtattctgctggatatggcgggcattcatcaaatgccatcataatatcagagccaagcgcattttggatgtccatagccttctcaggagaaaggaacagcttatctccatttaagtgattacggaagtggacgccttcttcttcaatttttctaaactcactcaaagagaatacttgaaatccgcctgaatcggtcaaaatcgctcgatcccagttcataaatttgtgcagaccgcctgcttctttcacaatgtcatgccccgggcggagccatagatggtacgtattgcttaagatgatgcctgcttccattgcctttaattcttcaggtgccatcgttttgactgtagccagtgtacctaccggcataaatacaggtgtgtcaaaggagccgtgcggtgtatgaacgcgccccagtcttgcacctgtttgtttgcatgatttaatgaactcataacgtatcggtaattgcgacaaaatgagccctcctgtctttgttgtatgatgttattgaatcagcatggcatcgccaaaactgaagaatcggtattcctcttttacagcctcattgtacgcctttaagacatgctctcgcccagctaatgcgctgacaagcatgattaacgaggatttgggcagatggaaattcgtgatcatgccatcaattgccttgaatgtatagcctgggtaaataaagattgacgtccagccgcttgacgctttgaattcgccatcatgcgcacttgcaatggtttctagcgttctcgttgacgttgtccccactgaaataatccgcccgccttccttgcgaacgcgattaagctctgccgctgtttcttcattcatttcgtaaaattctgcgtgcatttcgtgttcttcaatacgatctgcactgaccggacgaaaagtaccaagccccacgtgcagtgtaatgaatgcgatgtgcactccctttgctttcagcgcatccagcagctcgtttgtaaagtgaagaccagcagttggagcagcagcggagccgacttctttcgaatacacggtttgatagcgttcacgatcgtcaagctgttctttaatataaggaggcagcggcatttcaccaagggattcaagtacttcataaaaaatgccggtatactgaaactcaacttttcttccgccatgttctaattcttctgtacatactgcttgaagccgtccatcaccaaatgtgatcactgttccttttttcacccgtttggctggttttacaagtgtttcccatttgtcgccttcctcttgttttaagagaagcagttcaacttttgcacctgtatcctctttcattccaaacaaccgtgccggcagaacgcgtgtattatttaaaacgagacaatcacctgtttgaaaataatcggtgatttgtgagaaagtatcgtgtgtcatctcacccgtttgtttgtttaagaccatcagtcttgatgcgtctcgtttttcaagcggtacttgtgcgatcaatctttctggtaaatcaaaatcaaatagttctaacttcatttccttcacctattctgtagttaactagttaacgttatttcatccgtccaaagatattcagtaatatcgtgagcacgatgctaatgacaatgcatgtgatcacagggaaaaagaacgtcacatttccttttttcacaaaaatatcacctggaagcttaccaaccaattgaaatactaatcctgcggcaaaaaggacaccacctaaaatcatcaatattttagggaattcagtcacgaatcggaacctccatttgaaaatgttcatacgcttctcttgtgacgacccgtcctcttggtgttctttgcaggaaaccaatttgcagtaaatacggttcgtacacatcctcaatcgtatgtgattcttctcctattgtcgctgagattgtatcaagcccaacaggaccacctctaaatttttcgatcatacttaaaagcagcttgtgatcgatatgatcaagaccaagcttatcgacttgaaggcgctcaagggcatcttccgcaatgtcctcggtaatcgcatgattcccaagcacctgcgcaaaatctcttactcttctgagcagacgattggcaaccctcggcgtaccgcgggaacgtcttgcgatctcttcggctgagcgaagatcgatcccaatctcgaacagctcggctgttcttgagacaatgtgagccaaatctctttgctcatagtattccaatcttgcatgtaccccaaacctgtcacgaagcggcgctgttaaaagcccgacacgggtcgtggctcctacaagtgtaaatggcggtaaatcaagccgtacagagcgcgctgtatctcctttgccaatgacgatatctaaacaaaaatcctccatcgccggataaagcacttcctcaattgagcgctgtaagcgatgaatttcatctataaacagcacatcacctggctcaagagacgttaaaatagccgccaaatcaccaggacgttcaatcgctggtccagatgtcgtacgcagctgaacattcatttcattggcaataatcgacgcaagcgttgttttcccaagtcctggcggtccgtataaaaggacgtgatcgagcgtttcctgcctcatacgggcagcttcaataaacacgctgaggttatcctttactttttgctgaccgatatattggctaagtgtctgaggccgcagactttgctcaatggctgattcatggttgtctgcttcagttgagacgagccgttcatccatgagacatcaccctatttcaacattttttgtaaagcttttttcacatattgatcggttgtgagattcttttcttcttttaacaatggaagaacctttttaatttcacgatcaccgtatccgagaacagttaaggcttcaagcgcttcgtctaatgccgtttgctgcgtttcgacctgaatatggtcctcgtgattaaatagatttccaatcatttccggaacgacatcagctagctttccttttagatcgagaatgatttggcgagctgtctttttgccaacgccagggaacttaatcaggaacgcttcatcttcacgttctatcgctgaaatgacagcgccaggatcaccggaagcaagaatcgctagagcccccttcggcccaatccctgtgacatttaacagttttgtgaacagcgctttttcttctcgtgtttgaaatccatataacgaaaaagcgtcttcctttatgtaatgatacgtataaatcgtttcttgtttattgatttgatagataaacgggtttgggctatagacttgatatcctactccgccgttttctatgacaacatattgcgggcacacataatcaatggtcccttttacaaactctatcaccgttttcacctctttgactgttcttcattgtaacataaatcgagaagaaaaccgcaataaaagttaacatacgttcgctcaatccatttttacgatgacaccacgaaaaacagcttgcggccttcacaccagcaagctgttatacgctttaaaacgatatttcatttcggtaaggcttcatgacttcaagcacatgctcaaattcatcctttgttcgaaaaggaatgccttgctcaagctgctcctccacatgactttctaaacgggacgtatcaatttgaaaaaagagatgaatgggctccgcccagccgtcaggccttccatgaaacgtagaaatgacaccgtcctctgataatccgatatatccatttgctttacttaatggagagatatcatcaatttgctttctaaaaagcgcaaaatcctctttctgttctactagcgtccagcctttatactgcgaccagaatgtgtgtttgtcttctaatgatgcacggtgtctttcaatactcacatctccgtctagatagactttttcaagctgcacggtgatcgagtttgactgcttttgcaagtgttcttttccttccatatccgcagcgaaaaaaagcacacttgtcatgataagtcctgtaacgaaacatttcatcttcactttcactatttacacctctttaaaacatgagatcgatgcatgacatatgtagtttgacccatttttctaaacattaaccaaatggatgacatgaatatatgggaagagtctttcgttgtatccttcattcgtaaatggtatgttttatacaatccattgctttatcgaatgctcggttttttcatcattcgtttttcagccgcataaactgaaaccaaagaaggtgaagtcaatgtcagaagtcaaaaaattagccgaatcgattcagtatcatgaggataaacgtcttcataagcttgcctttaaaccggcagagcttgagctgtgcggcaaaggaagaagtgcctatgtcttttcatacaaaaaaaacggcaagaaaatggcgttaaaagtctttttcccttcttatcagcatattgcccgcaaagaagccgctatttatgaaaaactctctggttcgtcttactaccctgagatttatgaatctggggatcagtatattttaatggaatatattaaaggatatacattctatgaatgcctcacaaaagggattcctattaaaaaacaaatgattgaacaagtcgatgatgcgctagaagaagcacgcgagaaaggattgaacccttctgatatccacctgcggaatctgatcttaacgaaggaaggacaggtcagggtcatcgacgttgcccgtttcacacaaacaaaagcatgccatcaatgggatgacttaaaagccgcttacgcttattatcaaaaacctttcttcccaaaaaaagcaccgcgtctatggcttgaagtgattgcttatttatataaaaaaaactggctgtcccgcggtcagcttaataatcggaatgatttttctgcataatgaaagccgctcttaccgagcggcttttctgtgtcaatctgtttcaacatggatgctattcacatttaataagttaatgatttcattattcagcttaaaccaatgattggcttcttcaattttcttatacacatcataggtagctggacgtttcagctcgaaatcaagcacttccccattgttcatatgaaatgttaccttaaatactttcatcataagatcaccttccactctctcttgttagctggccgaatagatcggctcttttcattcattctctacttaactcgtttcccctccttctttcctttcaaacacaagaagtttaaattttgtttaaattcaaacaacatctctatccctcttctttgcaaagaagtatattgttttaaaaaggaggttttctttatgaaacggaaaaagaaacgaacatctccagaaaaacaaacaatcttgtttcatttaacagatgccctcattccgagtctggacatgatagggctgcattaaaggcatttttccacctcttaagaaaagccttttccgcgatctgataaaaccccgcacaacatgcgtgcgaggttcttttttaggatgaatatatttgacttccttgactgataaactccttcgccttcttctccatctcttttttcacttcttctgattgattgcgaatatcatgggaaattttcatgctgcaaaacttcggtccgcacatcgagcaaaaatgggcagtcttagcgccttcagcaggcaatgtttcatcatggaacgccatcgctctttctggatcaagtgacaggttgaattggtcccgccatctaaattcaaaccttgctttcgataaagcatcatcgcgcttttgagcagcaggatgtccttttgctagatcagcagcatgtgcagcaattttataggcgatcacaccttctcttacatcttctttgttcggcagccctaaatgctcttttggcgtcacatagcatagcatcgctgttccataccagccgatcatagctgcgccgatggcagatgtaatatgatcatatcccggagcaatatctgttgtaagaggccctaatgtataaaatggtgcctctttgcaaatctccatttgcttgtccacattttctttgattttatccatcggaacatgtccaggtccttcaatcatcacctgaacatcatgtttccaagcgatctctgtcaattcacctaacgtttccagctctgcaaactgcgcttcatcattggcatcagctattgatcctggtctaagcccatctccaagtgaaaaggcaatatcatatgttttcataatctcacaaatatcttcgaagtgggtataaaggaaattctcttgatgatgagcaagacaccaccttgccataatggcaccgcctcttgaaacaataccagtcactcgatcgactgtcagcggaatataccttaaacgcacacccgcatgaatcgtgaagtagtctactccttgctctgcttgttcaattaacgtgtctctgtacacgtcccacgtcaaatcttctgccacgccattcactttttcaagcgcctgataaatgggaacagttcctacagggaccgggcaattccgtatgatccattccctcgttgtatgaatgtcctttcctgtagacagatccatcatggtgtctgcaccccatctgatcgcccatgtcattttttcaacttcctcatcaatggatgatgtcacagctgaattgccaatgttcgcattgattttgacatgaaaatgccttccgataatcatcggttcactttcaggatggttaatattcgctggaatgacggctcttccgctcgctacttcctctctcacgaactcagggcttaactcttctcttaacgcgatgaactccatttcaggcgttacaatacctttttttgcataatgcatttgcgttacacaggcacctttttttgcgcgaagcggctcatgatgaaaatcagtatgaacatgttgatgagacgctttctctttggagcgatatccgttatcttcaggttttacatgacgtccttcatacctttctatatcccctctttcttcgatccatgctgctctcagacggttaagcccctttgtcacatcgatatgggcacgctcatcggtgtaaggtccacttgtatcgtacacacgaatcggttcattttgaatgtttcccgcctgcgtcacggtttgcgtgagggcaatttctctttttggcactaaaatgtcaggtcttgaccctttctcatacacctttcggctgccatcaaagcttgataataacgattgagttgttggagtattttccttttctttcatttgctgttctctccttctcttcttgtcaccggacaggatggaatcagcaccagcaaaaaaccaggctctatgaaaagaacctggtttcgtcgttagatataaacatgaatgtcatccataaatgacacatgtatcatcttcaacttccccacgctggtacgagccagatcaggtccaaagggttaagaagcttatacttctctctcagcccagccgcgggcacccctagtcacatttatttatttccacaacagtgtagcatagagatgccatgaaaaaaagaagttttaggaaaatagttcctttccactacaaaagagatacagcgagtttaatatacacctttatatacatcatccatcccaaacgtttaaataaaaactgaaataatcattgatccttttctcctattatgtataattaatctaaacggagaatttttatacaaacttttttaaaggaagttctagtcgattgcaaacatttctcacatttatcgtcgtaggattctcaattgctctgccagttggagcgatcacggttgaaatgacaaaacagggattaaaaaacggcttctttcatggtttaactgtaggagcaggcggcatgaccatcgatctcctgcttattttggctttatatgctggatttgctcagtttttatcactgccatttgtccaaatcccgctctggctgatcggagctatcttcttaatgattctcgcatacgattccattaagcatgcggatcaagacatccatttagctggcgaaaaagtcaataaatctttcgcaaaaacgtacagaaacggcttgcttgttgcggtttctcctggaaaccttgtgttctgggtttctgtattcggagctgtactggcagatgcatatacaaaaacagattcatctgaatttatgctggcatcaggcggtattttggcagggattctccttcatgacatcggtcttctcacccttgtatccttaacaagaaaagtgatgaatcgaacgatgatcaaatggacatccattattgctggtattttattacttgggtttggctgttatttcttttacgaattttatataggcattaaggtatatttttaagaaaaggctaaagttcttgaggaactttagccttttttattctctaacctatcgagtcatgcctgtttgacctgtttcaaattgtgttcttctcatatctctaaagcgtgtgaaagccccctcgtctttaatgacttggacagctcttccatccgcataacgagtcgctgcttcttccacttgtgatacgccctctgatgtcagacgtccatctgatttaatggcaatatacacattttcatctgttaccatcacctgtgagtctgcaacgtggttcattttattgacgcgattggcaatttttcttgaacgctgcacgttctcttgtttatcgtagccagagaacgacatttggttatgatagttcatatctccatgactgtagcgtccatctccacctgcgagaggcgttcgatcatctgcttgaggacgggtgcgataatcaacattcgttgtattcccaccgttcattccctccatgagttcagaaactggcccttgatgatcttggtgattgtcatccgctcggttattcgaatgatatccgactggctgacctgattgattatgacgtgtatctacacctgcattgtcatttgtaccacatgccgttaacccaataggaagaagcactaatgcgatcgttttttgccatttttgtctcaaacgaaaaaccccctgtacaaattcaatctcatgagcgcgaaacaggctctgttttagcatgtacagtttggggaaaaatcaagctgtcagttataaacaaaaaaaggaacgattgagatcgctccttctgttattactcttcttcgtcttcctctggtcttgcaaaaacagattgacctggatatggctgcatataaggctgagctggataagctcccatttggccataaggtacaggattcgggtaatgtcctggccacggctgatgctgcttcatgccatcatcacatccgcagtcttccttgccataagcttcatttgaaacatttggataaaagccttgattcacgttcgcattgacgttggcgttggcattggcatttggatgcatatggtggtgccagtgatgcccgtcgtttgcatgatgttcataatgttctccgtaataagctggcgcttgatacgcaggataatacggctgcgctgggtacggatatggcatcatgtgatggtgataatatggctggacaggatagcaaagacctgaccctggtaaaattggcgatgctggcaccatttgctgcggatatggatacattgccggcatgtaatgcccatgaccataataaggatcatatgcgtcatgatgctggtgatggtgatgatgttccttattctcagccattccccctaccgctgcgcctcctacattcggcatttgcgggaaattaggaaggtttgggtaattgctgtgctccatatcttttccctcctccttttgatgcggaatatgaataaacggatcatatccctttgccacttcatcttttaaatgacctttattttcatgatggaaatggtccttgttatctttatgctccttattctcatgatgaacatgatgatctttatgatcctttttgtcatgaacatgatctttcttttcatgaacgtggtcttttttctcatgatgttcttttttaggaggaggcgtaaatggctggtagagattggtctgataatagttcacatcgacttgcggaaaaactggctgctcgatctttggcactggcggtacataaggtacaggttcgtttggcttttctttcggcttcgtatcttgcacttgcacgacatcttttggcttttctttcacatacggatgttcttttggttttggcatttcttttggttttggcatttcttttgctttgtgatgatctgtttttacaggaacaccacttgatggaatcttgatcttcatacccggcatgatcaaatctgggttactgagctgtgaatttagttttttcaattcttgaaagtcgactccatatttctttgaaattttccaaagggagtctcctttttgcacaatatgaattttcaacgttttcccctcctatgcaaaacgtgaacgtaacggttatgtcagaagtacaatatgtttcaccataaatttatgcctatttacaagccgatatgataaaaacttgttttctgataggaggggctgatttattatttaatggcgagcattttattcagtgcaagtaaagcgtcttttgttgtgtcttcattaacttgaatcaaaccgaccggatcacctttctctatgctttctagtgaccataacaaatgagggagatcgatccgattcatcgtcaaacatggacacatatccggattaagggattcaatttgtttatctggatgctgatctatgatccgcttgaccaaattcatctctgttccaatcgcccacttgcttcctgctggtgcttccttgatcgtatcaataataaatttcgttgaacctgcaagatcagaagccctgacgacctcatgggtgcactctggatggacaaggatttgaatgtcgcggtctctttttctcgtttcttcaatattccgcaacgtaaatttctcatggacagagcagtggcctttccataaaatcatcttgatgcgggatagcggctgatcggtgatgagcctttcttctatttgatcccagacagccatttcttcaagtgaaatgcctaaatcaaaggccgtattacgccccaaatgctgatcagggagaaacagaatccgctctttttgtgtgagcgcccactccagcattttcttagcgtttgatgatgtcacagttgctccgccatgtttgccaacaaatgctttaatatcagctgttgagttgacatacgtaagtggaaggatcgtctccccaaacagatcagtcagctgctcccatgctctatccgtttgtttcatgttcgccatatctgccattgaacagccagctctcatatctggcaaaagaaccttttgatttttttttgatagcatatctgctgtttcagccatgaagtgaacaccgcagaacacaatgtactccgcttcctgattgtctgcagctatttgtgcgagctgcaatgaatctcctgttgcatcagcaaattggatgacttcatccttttgataatgatgccctggtataaaaagctttgatccaaaggcacgtttaatgtctaccacacgctgctccatctcatcaactgaccggtgtttatattcttctggcatcatcgctgcatgttgattcgcgagtacatcaagcagtgacatgagtggttccccctttatgactgaattccatattcatactaaaatcaaatgctggggcagaatgtgtcagaaaaccgagcgaaataaggtcgacacctgtccctctgtaacttggcaatgtctctagcgtgatgcctcctgaagcctcagtcagaattgtctccggcgtcatttgtttaaaacgttttacttcgtccggagagcagttgtcaaacatgatgacatcggcttttgcatcaatggcttcctttagctgcatttctgattcaatttctacttcaattttcaccatatgaccggcatatgctcttgctttctctacagcttcacgaatagagccgcatgcggcaatatgattatctttgatcatcaccccatctgataagccaaagcgatgattctttcccccacctgttttcacagcgtatttctctaacatacgcaagccgggcgtcgtttttctcgtatcacaaattgtaatcgacgggtccgctaatcgctccactgcttcatgtgttaaagtggcgatacctgtcatgcgctgcaagacatttaaaatgacccgttctccttttaataagtcgctgactggtccctttattttcgccagcacttcccctgaatgaatccaatcaccttcttcaaaaaacaactcagcctcaatctgttcattcagcaggcggtaccctatgtcaatgacttgagaaccagccaatacacccgattgttttgcgatgatataggctgttcctttcttttctccaaaaatgccatcagctgatacatctccaaaaccaatatcttctgcgaaaaaatgagtcagcatttgttttaactgtaaacgttccatttagcaccgatcctttcatttttcatcatgtgaatgtgacctttttcatggacaatttgcacaccccgccataatgcatcattccgatttggataatccattcgataatgaccacctctgctttctgtacgaagtaatgcagacttcacaagacaaatcgctaatgtccattgattgcttaattcgatctgttcacttgtgatatccttcacattcatttgctgataagggacttgctgtaatgtttgaagcaaggttttcagccctttttcgtctcttacaattgcggcatatgtcgtcatccattgtctcaactgatcctctgaaatcgctggcacaggccatatttcttgaattgagaaagaggagattgtttttttctgtttaggtatttcttcaattctccgtgccgctttgtttcctaaaacgagaccttccaagagagaattactcgccaatcggttcgctccgtgtaagcctgtacaggccgcttctccgatagcaaaaagagatggaaccgtcgtttctccatattcattcacgcagattccgcccattaaaaaatgcataccaggggaaactgggagcctgccgcttgctatatcgacacctgcccgctcacacattccagcaattgctggaaaacgaactgagaaatgtgaaatttcgctgatattgagatacagctcatgacctaattgctgctcatgaaaaatagctctagagacgatatctctaggcgctaaatcaccttgtgggtgaatgcctttcatgattctcctgcctgtttcatcttctaaataggctccctctcctcggactgcctctgaaacgagaccgactgcttttccagcgatcgtcaagagggtaggatgaaattgaacaaattcgagatcagttaattgtgcaccggctcgataagccatcatcagtccgtctcctgttacagaagggtcatttgtgtttgtttcataaagggagccgcagccgcctgtcgataagacaacggcatctgcggtcatggtatgtacgtgacctttctcatctctccataccacacctatgcaggttccttcatgaacgagtaaatcaatgacatggtgatattcatataaatgaatatgtgagccaagctgattttttaaataatgaacgagggttttgcctgtttgatctcctcctgcatgcaaaatgcgatgagtcgcatgtgccccctctttacctaattgcggcacgcccgtctccgtttgatcaaatggacagccttcttctacgagctgctccaccatatgctttccaagactgacgatctcttgtaccgccatctcatcattgtgatcacagccggcagctaatgtgtcatgtacatgctgatgaacagaatcttgtgctgaaaaggcagcagcgatccctccttgtgcaagcatggaattgctagaggaaaattgtttttttgtcatcatgatgacttcgcagcttgctgaaatggtttttgcaaaggaaagtgctgcaatacctgatcccaccactatgatttttttaattgatgacaccatcgcccctcctgtcatttacacctgtcttgacacatatcattacacaacactacaataaatacaagaaaaaattttcacataggagatggatgtattggtttatttagattacgcagcttctacacctgtttcggaggaggcactgcatgtttttcagcagctaagtaaagattgctacgggaatgcaagcagtcttcatgatgcaggcggaagagcaaatgacatactgacctacagcagacaatcaatcgctgccattcttgagggcgaaccagacggtatctactttacaagcggcggaacggaatccaatcttcttgcgattcaatcgatggcaaatggtctgccagcacacaggcagcatgtcatcacaacttctgtagagcatccttctgttcatcatgcggttaaaagcttagagcgtcttggcgtgaaggtcacaatcattgaaccgaatcaagatgggatcatcactcaggacattctcaaaaatgcattattacctgaaacaggactagtatctattcagcatgctaattcagaaacagggattatccagccgctcgctgaattagcacccattttaaaagaaaggcacattctttttcatacagatgccgtgcaaactttcggaaaaattcgtgtgtccatcatggagcttggggttgatgctgtatccatctctagccataaagtgtatgcacctaagggcgctggtgctgtctatatgggcactcaagttccttggaagcctttatattcaggtgcagttcaggaaaatggcttccgcgttggaacagtgaacgttccatgtatcggtgcttttgctactgcgagcgagcaattgatgcttaagctagatgagcaaaagcggcaaaatgagcagcttcgtgattattttcttcagcagctgaaaatgagacagcttcctgttcgtacacttcacaacaatagcaatcgccttatgctgcctcatattattggttgtttttttgaagggtttgaaggacaatatgtaatgttagcatgtaaccggcatgggatttgtatatcgactggaagcgcatgtgcttctggttatcatcatccttccccggctgtgaaggcattgcacgtatcagaccgtgatgctcttcaattcattcgactatcatttggatcgaagtcatcaaaagaggacatcaatcagcttttgcatacatttgaacaattgcaaaaggagaagaaaggagcataagacgtggagcaagagaggaaactcattggcgaagagagaagaaacgccattttagagtggctgaaagaaacagatacaccactcaccgggagctttttggctaaaaaggcggctgtctctcgacaagtcattgtacaagatatctcactattgaaagcaaaaaacgaacccattattgccacaagtcaaggctatgtgtatatggcatctcagcatacgccagaaagagaaattgaacaaatcatcgcctgcaagcatgatcctgttcggacagaagaggaactgactttaattgtagattttggggtgacggtaaaagatgtgatcatagagcaccctgtttacggtgaactcacggcctctattcgcgtcagcactcgcaagcaagtagctgatttcgttcatcacatttctaacacgggcgcctcctacttgtcagaactaacagacggcgtgcatttacatacactcacttcttacagtcaaaagcagcttgaccaagccatccaagcgcttgatgaagctggctttttaattaaagactaaaaaaaatagtgtcctgtaagggacactatttttcattcgttagttcatatgtttgatagctgccgagcaatttgacttcacagccaatcgcttctaattcctgaatcgcaccagggacaaggacttcatccatttctttttctatatctataataaacaaatagtgtccaagacccgtttttgttggacgagattcaatttttgacaagttgagattccgccaagaaaaggcagataacacgcgatgcaatgcaccggattggtcatcctttggcagactgacgacaatggtcgtttttggcttcgatgagaacccagcattcatcgggaacgatgctttaggatctttatgtaaaataacaaagcgtgtatgattgtgcggataatcatgaatatctttttttgcaattgttaaaccatacgtttgtgcggcaatttcattggcaatcgccccagcagcttcatccggatgctcactgatatacttcgctgcataacctgttgattcaactggacgatgcggaatatctgggtactgctttttcagaaattgatgacactgggcaattgcatgcggatgtgattggatcacatctaatgtctcccagctttccgctcttgatgggtggacaagcaaatgctgacgaatcggtgctgtcatttcaccaacaatggacagcgcttcttcatgaattaaataatcaatcgttaagttcacagatccttcgagtgcattttcaagtggaacgaccgccaaatcgacttcgccttttgatacagcatccatacattgcggaatcgttgcataggcacgctgcactgcatctgctggaaagcaagagcatacggccaaatgagtaaatgttgcctctggtccaaaataacctacagttaattgcttcatctgctatgatctctccttttacgccccagaacctagaatttcaactttttcgacaaattcaagttttcttaattgattcatgactgtattgatatcatctgccataccagccgtgctaatggatagggtgacattcgctcttccttgtagcggaatcgtttggtgaatggatagcacattacagccagagtcagccacaatttgcagcagtcttgacagagctccagaccgatcctcaaggtggaaaaacaatgtgatgatctgctctttcaccatcgtataaaatggaaaaacagcatctctgtatttataaaaagcactgcggcttaaatccgcttgttgaacagcatcggcaactgaatccgcttttttgcgatcgagaagctttttgacttcaagcgttttccgcatcgcatctggaaggacatcctctcttactaaatagaacgtttcttctttcacctgttttctccccttttaaaaacgggagagcccatggactggaccctccttctgatcaatcaataaattcaaattcaaattcaagcagacgaatgatgtcaccgtcttgtgcaccacgctcacgcaaggcatcatcaacgcccattccgcgcagctgtctagagaatcgtttcacggactcatctcttgagaaatctgtcatcttaaacagccgctcaagtgctttacccgttatgacaaatgtaccgtcaggatctcttgtgatctcaaatggtgcatctccctcatcaaacctgtacatcacgcggttatcagacagttcctcttcattataaagcgggaattccggtgttgtttctagctgattggcgatttcaaataaaagctcacgaagcccttctcttgtaatcgcactaattgggaacactttatagtaatccgttaatttttctttaaatgccgctagattgtcagctgcatctggcatgtccattttgttcgctacaatgatttgtggacgctcagtcaatctcatattgtactgctcaagctcttcattaatcgtcacataatcttcgtacgggtcacgtccttcaagtgctgacatatcaatgacatggacaatgacacgtgtccgctcaatgtggcgtaaaaattgatgacctaagccaacgccttcatgcgcgccttcgatcagtcctggcagatccgccatgacgaagcttcgattatcatctgtttcgacaacccctaggttcggcacaagcgttgtaaaatgataatccgcaattttcggcttcgctgaagagacaattgaaagcagtgtcgacttcccaacacttgggaaaccaacaagtccaacatctgcaagtacttttaattctaagatgacgtcacgttctttacccggctcgccattttcagaaagctgtggtgcagggtttgccggtgttgcgaaacgtgaatttccacgtccaccacgtccgccttttgcaatgacagcccgctgtccatgctctgttaagtcagcgagtacttgttccgtctctgcatccgtcacaaccgtaccgggcggaactttgacaatcatttcttccgcatttcggccatgctggtttttactcattccgtgctcgccgcgatccgccttaaaatgacgcttataacgaaagtccatcaatgttctgagtccttcgtctacttcaaataccacatctgcgccatttccaccgtcgccgccagccggcccgccttttggcacatatttttcacgacggaacgccaccataccgtttccgccgtcaccgcctttaacatacactttaacctgatctacaaacataacttcctccgtttctctgcatcacatatctcattcttgcctcaaacaaagctcaatcatcgactcatgacttgtcacatgaaattgaactacactcatacatggatagtttgcgtcatgaaacacatttaacgcatccaaacttgttaattttcctttgaaatcaaaatataagaccacatcattctcttcatgatctgtttggaacgtgaccgttaaatgattttcagttttttggcaaactgattgatcgaatatcgaaaacaactcctgtgataccgatagcagctgcgattcatatgctgataagtctcgggtttcaccaagcacttcatattctagggtgataaaatgcgactcccaattaaatgttagaaagtaataggccaattggggaatttttaaatttgagagtttggattcatgctgtgcttcaatgaccatttcttctataatttcaaacacacggtcatatttttctaatgtcaagttgcccttgatcagctgcaatttattcatccagtcatgtcttgaacgactgagcagatagatcaattcatttgttaatgcaacgtgagttaatttttcgttttgtttacttgatatctcttccattatcgcactcccaatcgtttggtctctcttttaggagtcttatcatcactatgtctccctgaattataacagagaagacagcatagaaaaacactagttatgtgaggaaaggttgttttttctgatctataggagaaaatgaggcaaagtcagcaaacgttctttgatattgatggagtgcatcttctttttcatcttcgatactacttgtaaaaagtgaaaaaaactccagtcaatgaccggagtttttagcaattattgtgccgcaggatatacgctcacttttttacggtcacgaccgaaacgttcgaatttaactgttccgtcgattttagcgaaaagagtgtcgtcgcctccgcgtccaacgttttcacctggatagattttcgttccacgttgacgataaaggatagaaccaccagttacgaattgaccatcagcacgtttagcgcctaaacgtttagactcagagtcacgtccgttctttgtagaacctaccccttttttagatgcgaaaaattgaagatctaatctaagcatgaagttcacctcctatttttttgtagatattctcacataatcgtgataatctcgttcaattgtttctaaggaaacgaccatgccttctaaaagcaactgggctttttcaaaggatactggatctgtatcagctggcaattcaaaagagaaatagccaccttcctcaccaatatcgagcagagggtccaatcctgtcagtgcaataattgaattgactgagccgaaaacaacagcagatactcctgcacaaacgagatcctgacctttttcagcaaactcggcatgtccagtcatctgaaaagacgtaatgctttcatctgctgccgaccgagtaatggttgctttgatcatatcactcacacgccttaagcgttgattttttcgataacaactttagtgtaaggttgacgatgaccttgtttcttgtggttgtttttcttcggtttgtacttgaacacagtaattttcttaccgcgaccttgtttttcaactttagccgttactgttgctccagcaactgaagggttacccactttgacagtgtctccgccgacaaacaatacgttttcaaaagttactgtttcacctgcttcagcagctagtttttcaacataaacagtttgaccttcttcaacttttacttgtttaccaccagtttcgataattgcgtacatctctgcacctcctaataaactcagactcgccgaatacagggggccttaggctctttacacctgcttcgcgcggttgtagcacgggtgctacatatccataacattaaaaaatatatcaaattagacgcagaatgtcaacgtattttcatcactagtacggcaaaagaagctcttccatggaggaggtagttcttcgatctgaaaaatatgcatgaagcagttcattttcgtcaagctggctcattttcacgccatctctttcaataataatcggatgcttacagcctctttggaatcgcgccatgacttcatatactttttcctcagcgctcgctctcagcggaatcagcttttctaccttttgctcttttttaccgtaatagcgttctagtaaaaagcggaccctgacataatgccgctgccggtgctccatcacgagtgaataggctaaaaaggtgagcagcacccagccgttgaattgaagcggcgcaaacaaaagtaatccgactgtcaatagactgaaaaagacaagggagccttttatggtaagagcatgtgctcgttggaaagggtaatatgctgataagagcaaaaagaataattttccgccatctagcggccaaatcggcaaaagattcacaaggaaaattgccatattataaaaagtgaacatcgtaaaaatgtcgtgtgaaataaaagaagcttccatgaaaaaccatgccataagctggagcggtacatgctgaagcggcccgcataaaatgaccgccagctcttcctttagcgggcggttaccatgctcttctacttctaccgctccgccaaacgggagtagaaaaatccgccgaatgcgccaatgataatagcaagcagccgctgcatgtccaagctcatggacaaagacgataatgagcagacaaagcagcggcttgatttgaccagagagaatcgcaaacgccatcacaatccacagcagcggatgaatgtgaattttcgtcagcatgaccagccatctattcaaaggtcatcacctgaatagggtcgataaactgttcattctgcttaatggcaaagtaatatgtgccctttccttgatcatcgagtgagatctggccaattttctcacccttatcgacaaaatcgtataaggccacatcggctttctttaattgaccgtaccagctatagctgttatctgcatgctgcacgaccactgtcagacctgtgtcacttttctttttcacttctactacatagccttccttcatgctgtcaatcgcttcagccgctgtttcgactttgacacctgctccgttttgtgtaaaggattcctgcacttttccagaagcaggtacagccagttcttggttcgcttgtacatctttttggtcttcctttttgcccgttaaaaaggcaagggggtttccaactgttttctcaaaccagcgattagcagcagcaaattgaaaatcttgctcaaaggtctgcgtaatgatcggcttcagctgctgaaacggccctgcctgacctttaaacgaaatggctgtaatcaacacaagggatgcagataataaacatttcagcacaaaggcattggggttaaatagcggatgctgatatttcttcggctgatgagacgacgattcaaaggaagacgaccctgaatgcttttcttcctctgtcagcatgacccatggagggatatcctcttttttcttgaaagtcgtcttcttagatggagcagctgactgcttcgttttgcggcgctgcgcgattttctttcggtactcgtccacacttttcatgagatcaccctttacatacaaacagtttgtacattttatgtggcgacctcatctgatatgcaacaaaaagaccgattctgatcgaatcggtcttatcttacctgactgcttattaagctcttacaccaaaaaatgctttcagcttagcaaacattcctttgttttcatcttcaaatgattgaagtggaacagattcgcctagtacgcggcgggcaatattacgatacgcaatcgagactttatttttagcatccatgacaatcggttccccgttgtttgaagccttaatcacgtcatcatcatcagcaacaatgccaagaagatcaatcgataagtgatggacaacttcatccacatccattgaatcgccacttttcgccatgtgtgtacgaatacggttgacgatcaaacgaggtggttcgatatcttcttgttctaacaagccgatgatacggtcggcatctcttacagctgagatctcaggcgtcgtcacgacaattgccttatctgcaccagatacagcatttttaaagccttgctcaattccagcagggcaatcaatgacgacataatcaaagtcttgtttcaatgattgaattaattctttgatctgctctggctctacagccgttttatcgcttgtttgagcagcgggtaaaagatataaaagatcctcgaaacgcttatcttttacaagcgcttgatgaattttacatcttccttctactacatcgactagatcataaataatgcggttctcaagccccatcacgacatctaaattccgaaggccaatatcggtatcaactagacacacttttttcccttgaattgctagtgctgtgcctaagtttgcagatgttgttgttttgccaacgccgccttttcctgaggtaatcacaatagcctcgcccaatttcacattcctccctcaagccttgtcagattaggtcttatatgagccaattgctgcaggcgttcaatgatcatgttgccatctatatctaaataagcacattccatttcatttccatcttctttttgatctggtgcacggttaaacacttgtgcgatgcgaagctgtgttggaatcatacgagatgccgcaatgacagcttgtttattcccattacatccagcatgtgccacaccttttaaagcgccgagcacaaaaatatttccccctgcacgaatcgttccgccaggattaacatctcctattaataagagatctccttcaacatacagtacctgtccagagcgtacaattttcgctacagaggtaatttctgcctctgcttttaatcgtctcgcctcttcagtagacatgacgtcactttcaatagaatgaatgacgagatgttcattttcagagacagcttcagtcaaacgcatttcctgatcctctgttaaataccgaaaaccaagcttaatatgcacattaaccttatgaccttcccttccatctgtatattgctcaagtaaaagaacctctcgcaagccagaaagaaggtcatcaaacgaacagtcatcatttaactgtaatgttaatccgttttttgtaccttttatcgtcacatattgctgtttttgagttttcaagatgctcacctcaacaacatactcatttcgccgtaattggacaaactcctgcttttattcgtcgatcagtccttgtttcatattgatgaaaaagagcctaagcggcacaacaagtatgagagacgcagcagtatttaaaagaatcgttggaataaagcgttcgatgacatacgtattaaacggcataatccctggttgaattgtcgcttgaacgccgtacacataaaactccatcacggaaacagcaataatcgacagaaagacgaccactaacatattcgtttgcaaaactttaaaggctttcgctagcaaatagcagagcgctccaaagccaaacatatgaacaccaagtatgcccgtatacgaaatatcatataaaagtccaaagataaaaccgaaaatcacaccatatttttgattcacaaaagccgtcataaatacaagtgcgagtaagatgaaatgaggagctaaaatttgattgtctgaaacaaatgggagcttcactagatcgacaaaaatactgtcaaatacgaagataaacaacatgacgaaagcaagaaggacacgtctcacgagccttcctccttcgtcaattcagatgcatctcccgtacttgagctgcgattcaccacaatcacgcggtctaaattgttgagttcagccgctggttctacataaatgatttttgtcaggccataatgatctggctcgatttcacttaccttaccaatcgtcaagccttgagggaatacgccccctgctccagatgtttcaacaagatctccttttttgacatctccatctgcatcagatttcagaatattcattgtcagcatttttttcttactgtcatagccgttaataattccgttgagttcttctttgccctttttcgcaaaaattttcgttgaaattctattattttggtcagtagagcttagcaaccttacagtcgaagtaaaattgttgagcttatcactttcaatcttcccaattaacgcaccactctcatttgtgaccgccatatctttgtcaacgccttgtttttttcctttatcaatcatcacaaagctatcccaaagggacgggtttctcgcgataaccgttgatagaattggcgtataatcacgaatagagttcacatatccgagctgcttgcgaagctttttgttctcatcttctagttcttgaagtttcgcctcatattgggtttgtccatcaagtttttttcgaagacgttcgttttcatcgtatgtgttctttaaatcttgaacatttccataaataccggcaataaattgtgatggtttatgaaagacaccttgaaaaaagcctgtcgtatcccccactaatttttccggccatgaagcacctctgccgcttttcactgaaaaaccaatcatggccaccagtacgatgacacagacaaggagcaacattaatcttttattcataaaaaactgcggcatgtcttacacctctttatttacgcccgattatcgattatcttttgattttcctttgaacaaatgaatatgctctagcgctttgcctgttccgattgccacacagtcaagcgggtcttccgcaataatgactggcatcttcgtttcatcactaatgactttgtcaagattacgaagcaatgcaccgccgccagttaaaacgattccgcggtccataatatctgctgccagctcaggcggagttttttcaagtgtcattttcaccgcatcaacaattgtttccactgtatcgcgaagcgcttttgcaatctcatctgctgtaatcgagattgtttttggcagacctgttaaaaggtcacggccgcgaatatccatttcgtcatgtacatcaggctgcgcagaaccgatttccattttaatcgcttctgacgtacgatcaccgatcatgaggttatacgttttacggatgtagctgctgatggcatcatccatttcatctcctgccacgcggattgattgtgatgtcacaatgccgccaagagaaataatggctacctctgttgtaccgccgccaatgtctacaaccatacttcctgttggctcccatacaggcaggttagcaccgatcgccgcagcaaaaggctcttcaatcgggtatgcgtcacgtgcaccagcttgtcttgttgcatcaatgactgcacgctcttctacagctgtaataccagatggtacacataccatcacgtaaggtttacgagcaaaaagccctttgccttttaatgcttgattaatgtaatatttcatcattgttgctgtcgtctcgtaatctgcaatgactccgtctttcatcgggcgtagtgccacaacattaccaggtgtacgaccaatcatatttctagcatcatttccgactgccactatagacttcgtatcagtttccaaggctacgaccgaaggttctcttacaacaatgccttttcctttaataaaaacaagcgtattcgctgttccaagatctattccaaggtcttttgtaccaattccaaacatatgtatgtatcttcctttcttaaaccaaaattccctttagggaaaaactcataaactctattatatcgtaaaacattgaaaaaaaaagtgttacaaataccctttttccttcaaactcacaaatttttgatcacctatgactagatgatcaagcagctgtattccaatcagctttccacattcaaaaagtcgctgtgtcacttcaatatcttccctgctgggcgtcggatctccagatggatggttgtgcacacatataaatgaagcggccgaacgtttaaaggcctctttgaaaatttcacgcgggtgaacgatcgatgaattcaggcttccaataaacacggtatgtttatgaagaacttgattttttgtattaagataaagacaaacgaaattttcctgtgtcaaaaacctcatatcttccatcacaaagttcgctccgtcttctggtgtgcggatcacatagcggttatccgtcgtttgatggtgtaatctagtgccgagttctaaagcagctaaaagagaaatcgccttcgcctttccaactcctcgaatcttcgacatttcttcaattgaggcttcttttacagagcgaagaccgccaaatgtttgcaaaagtcttgcggaaatttggagaactgattcttttttcgtgccagttcttagaaggatcgcaacaagttcatgatttgacaaactgctgggcccgtatttgataaatcgttctctcggtttttcatcatgagggaaatgctttagcagcatagggaaatcgttcaggatgaccactccttttagaattccttcctgtcttcaaaaaggggtgattccaaaagtttcaagcactctgactgttttcgcaataggtagaccgacaacggaaaaataatcaccatctattttttgaacaaacagtgcgcctttcccttgaatgccatagcttcccgctttatcaaggggttcgcgcgtatcgatatagcggtctatttcattttgagtcagcgcccaaaatgtcacttctgtctgttcataaaatgtttcttttctattctctgactgaaccgtgacacccgtcaagacttgatgtgtctttcctgataataattgaagcataaaagccgcttctttcttgtcttttggtttcccaagacatttgccgtgaattgcaacaattgtatctgcaccaatgaccacagctttggggtttaatctttgaatatcatttgctttttgttctgccaaccattggacgttctcagcaggtgaaaggtttcgatttatttcttcttttaaatgacttgcttgaatgtcataagaaaaccctgctagatcaagcaattcttttcttctaggtgattgcgatgcgagaatcaattggttcatgtttgttcatcctttcagggtttagcctaagaagtaagatacccattcatcctagcaaatgtacatcttaccgacaatttacgaaaattcatttttcatgtaccttcatcattatgttggatgcaaaagaaaaaaactagtcattttttgactagtttcgtttcttaaaaaatgattttacgtatttaattgatcaagcaatgcctgctgagatttccagccgttttcagcagttgggtcatttaatagctgcacagctttcagcaaaccgcttttagccggtgcgtcctctgttttggcactttcaagctcagaaattagctgcgtgacttctttttgatctacttcatcgcctgcaatcactttggatgatagtacagatgccttttctattaaactagtcagctcatctggtacttgaaatgagagctcctttcctccccatgcctcaaagtgctgatcaatcaatttcttccctacagcgcttgtcatcccctgctctgtcgcaagcccggcaatgacataatatccatcatccatggaaacctttttccctgcataccctgcatcttttaaactgccaactaagtcatctgctcctttttcagaagaaaatttcccagcctgtacaacaaaggttgataaactgccagaggcacttttttcatctttgttctcttttgattcatctgtagtgcctgcattcggctcatccccgccggctttcatcgatgattgatttccagaaccagatgccgagacactgatatctccacctgaaggatttgatgtaccatcttgacttaaactaagcgcaaataccccaaggcctgtcccaagaacgaccgcaaacacaatcgttgtcatcactctcttaaacggaccgcgatttttaccgaacttctgatcaaaggagctttttttcttttgataaggtgtgacgacttttggatcagaatgataaatatgatcagcagcatcatcccactggaaatcttcttctttcggtttagacgaatcttcctgagaagctgctgtctcctgttccgaatgtctcttttcttcccaattcgaaaacgtcacttgatcttcttgctgttttggcggctgatgatcatcttcatgtacgatttcttccttgccattaatattgacctttagcccttgtttttttgcctgcctctttttcactgtcattccccgctttctgacatgtttgtaagaaagacctttctgtccaatgaatcagtgcgaatttaacccgtccttctttctgtttcacactttaacatagcaggaaaaaaaaagaacaagacttttgtcggcagggcaaaaaagtgttcgccaattttttcaccccttcgactagccaaatagaaacaagacaggggcaccacagagatacagcagaaatgaaaaagcgatcgaaggaacaaaagggaatggctcgtttaatcgaaaggaaaagacctttgcataaaccattccagcaatacatgagagaaaaagcatgagaaggaacggcttgaagccaaagcaaaacgcaagcacactgaacagcttcatatcagctccgcccatactatttggcttaaaataatctagactagaaaacaaaagaatgcaaaaaatgagagaagccgccccttcccaccagatcagaagcggttccagcgtgcggtatatgacgaaaagagggaaaaagaagagaaacagctcgttcggcaccctcatatagagaagatcactcacgacagcaatcacgaataaactacaaagaatcacaagaaaaagaccttcaaacgaaaaacctgtgatgctataaacaaataaaaaaagaccgcctgacagcagttcaaccattgggtataaccaagatagacgaatgccgcaatgtttacaagaccccttccatacagcataagaaacgagcgggatcatgtcgtgcagggatagcggctgtttacaggctgtgcagtgagaacgtgggaagagaatagaccgcttcaccggcagcctttcgcctacgagatgaaagaacgaacccatcgtgatacctgcaagaaacaaaaaaatctcaatcatatgtggaactccttccgggaataagatagaccggattttaccatgaccctatccactaaagcatctagtgaaaatatgattttccccctcttctacatataaaaagaaaaagacgcaggaggcatcaaagccatttgcgtcttttcgttacccgatcatacgatttcgtatatctgaaataaaataaagggagcctgtcacaaggatcaccgctaaaggatcatcactttttttctgaatgaactcaagcactgcacgagggtcatcgtcatacgattttgcctctaactgactgcacgcataaagcttttccgctgattcagctcttggaaaatcaaatgaaacaaaatggatagaggaactaacggcttcaagtttttgaatcatttgcttgtacggcttatcttttaaagcactaaaacagacatgcacttgtttactagaaaaatgagcttgtaccgtttcaattaaacggtcgatcccttcttcattatgagcgccgtctaaataaactggtggatgatctttaaccttttcaaatcttccagcccaaactgcataccgaataccttcatatatctgctcttttgccacgctaatataaccttcttgctccagccattcaatgagtagaacagcaagggaagcattttgccgttgatgcgttccgattaaccctgtttcaagctgcggatactgcctttttggtgtgcttaacgtaaactgttcgcctgtttctgttggctgctgatgactgaaggtacaaatatcctgtaatgaaatacattccgccttcttttcttttgcgatgttttgaatgaccgcaagtgcttccggttgatgaacagcagtaatcatcggaataccctctttgataatgcccgctttttcagatgcaatttgttcaagtgtgtcacctaaaatcgccatatgatcatgaccgatcgacgtaatcgctgttaagatagggacggcaacatttgttgaatcaagtcttccgccaaggcctgtctctagtaggacaaagtctacttgctgcacatcggcaaaataagtaaatgcacatgcggtaatgatttcaaactctgttgctgcgccaagctctgtttgatctaactcatcaacaaaaggcttgattttattgaccaaactcagccattcttcatcctgtataggtgctccattcacgctgattcgttcattgaaagttaaaataaacggggaggtgaaggtgccgactgaatagcctgctgcctgtaaaacggaacgagtaaacgcaatcgttgaaccttttccgtttgtacctgcaacatgtactgcttttatacgttgttccggatggcttagtttgttcatcagccacttcattctttcaagacccggttttacaccaaaggccaatctactgtgaatccactcaatggcttcatgataggttgtaaacaatgtcatctctcatttcatccgaaattttcaaaaaagacgactccattttgttaggagccgtcttttcaaccttatgctttcagctcttcaatacgcttttgaacagcttcgcgttttgcgacatagtcacgttctttcgcacgctcttcttctacgacactttcaggtgcttttttcataaagccttcgttgcctagctttttctggacgcgctcaacttcttttgtcagcttatccagttctttttgcagacgagcgatttcctcatctaagttgattaagccttcaagtggcagaatgagctctgctccagaaataacagccgtcatcgctttatcactagctgggacgtttgtgccaatttcaagtacacttgggttcgtaaagcgctcgatatatgaacggtttttctctaagcgttcctgcacatcagatgtagaggctttaatgtaaagctctacctgtttgctcattggcgtattcacttcactgcggatgttacgaacagaacggatgagctccacaagcagtttcatatcagcagacgcttgttcgtttgaaagctccggtttcacctcaggccaagccgctacagtaatcgattcaccttcgtgcggaagatgctgccagatttcttctgttaagaatggcatgaacggatgaagaagtctcatcgtctgatctaatacgtacgcaaggatggaacgagtcgttttcttcgcttcttcatcttctccataaagcggaagcttcgccatctcaatgtaccagtcacagaagtcatcccaaatgaagttgtataaatgtctgcccacttcaccaaattcatacttgtcagctagctgtgtaacactttcaatcgtttcatttaagcgggttaaaatccattggtcagccactgatttttctccagtcaaatcaagctcatcatacgttaagccatccatgttcattaaagcaaaacgcgatgcgttccaaattttgttcgcgaagttccaagtggattcaaccttttcaaagctaaagcgaagatcctgacctggtgagcttccagttgctaagaaatatcttaatgaatctgctccgtacttgtcgatgacttccattggatcaattccgtttcctagcgacttactcattttacgtccttgctcgtcacggatcagcccatgaataagaacgtctttaaacggtttttctcctgtgaattcaagaccttggaagatcatgcgagagacccagaagaaaatgatgtcatagcctgtaacaagcaggtttgttggatagtagcgcttgaagtcttcactatctgcatccggccagcccattgtagagaaaggccaaagcgctgaactaaaccatgtatcaagcacatcgttatcctgttcccagttctctatatcttttggtgcttccagtccaacatatacttctttcgtttctttatgataccaagctggaatgcggtgtccccaccatagctgacgagaaatacaccagtcacggatattttccatccagtgtaaatacgtcttttcaaagcggtctggaacaaattgaacttggtcatctccattttgaaggttgatggcttcgtctgccagcggctgcatttttacaaaccattgtgttgataaataaggttcaacgacagctccgcttcgctcactatgaccaactgaatgcatatggtcctcaattttgaataaaatcccctcttcttgcaagtctttaacaagctgtttacggcattcaaagcggtccattcctttgtattgcagtgcatttgcattcattgtgccatcttcattcatgacaagaatacgctctaagttatggcggtttccaagttcaaagtcattcgggtcatgagcaggtgtaattttcacagctcctgaaccaaactccatatcgacatagtcatcagcaacgattggaatctcgcgtcctgtaattggcaagaccactgtttttccaatcaaatgctgataacgttcgtcatcaggatgcacagcaacggctgtatctccgagcattgtttcaggtcttgtcgtcgcaatttcaattgaacctgtgccatctgaaagtgggtatcttaagtgataaaacgcgccttgaacatctttataaatgacttcaatatcagaaagtgccgttttcgtcgctgggtcccagttaatgatatactctccgcgatagatcagccctttttcatacaactggacaaacacttggcgtaccgctttattcagaccctcatctaatgtaaaacgttcacgcgagtaatcaagaccaagtcccattttcgcccactggctgcgaataaagtccgcatattcttctttccacttccacgtttcttccacaaatttctcccggccaaggtcataacggcttacgccttcttcgcgaagctttgcctcgacctttgcttgtgtcgcaataccggcatgatccattcctggaagccatagaacgtcatagccctgcatccgtttcatacgtgtcacgatgtcttgaagggtcgaatcccatgcatgcccaaggtgcagttttcctgtcacgtttggtggaggaatgacgactgtatatggatctttcgttttgtcattttgtgcttcgaagaatttcccttcaagccagtacgtatagcggtctttttctatcgcatttgggtcgtactttgttggcatttcttgattatttgtttccatttatgtaacctccacattttttcggctgatgaaacataaaaaaagccttttcatccttataaaaggacgaaaaagctttttcgcggtaccaccttttttcatggaacacatagacgtgtcccatacactctaaaggataacggggttctcccgaatttctctacttgttcattcaagaaattaagctcacaggcgaccttccaaacaagtacatcctaggaaacctttcagcacatggtctccctctctttagggtcttgctcgtactcttcctgatccacgcttacgatatatcacgttcatcagcacatactcatcttttatttatattactaaatgccttttgttttcgtcaatcatcttttccgcttttcttcttctttatacaaattaggcaagcaccctttgcctctttgcccatatgataataacaaaatgaagaaggagggcgtttgctttgaaaaagatcaatccttacacacttcccccctggctgagacaaattcgggcagtggcctcccaagtcgttctcccgattgcgatatttcaagggtttcgtacgatcattttccccacaacatttgacgtcctcatcttaggtattctcatttttctcgcctgcgcctttcaccttgattggttttaaacactcgcgcttatgtaccagccaatatgaacacaaaataacctcgtcattccgctgatgacgaggcactttgttcttcttcaagccgtctagcctgctcaatctcgtgtatcttcatgacggtcggctctgaatttttcatctgccaatacgctcttaacagctgttgacagctttccatctcatcctgcccgcctgcttcataggttttaactgtatcaaacagaccttgcggataagcaaggtaactaaggaacagatgaagctcttcctcccgaagaggatttcctttttggtacgtataaaacaaggaagtgcattcaggacaagacgtgggataggttttgaatgtccgaaagtaaaaggtcagaagatcataaatgggggcggcttttttagaccgctcaaaattggtgaaatgtcctgtgcctacatcattatacaaaaagtgatgaatcgacagctgcccatgatttaagacaacacgtgttgtttctttatctttcatttcttcatgccaatcttctaatcgttcgagggcaaattcgctggcagacatcgcctctgaaaaatacatcgcagcagtcagttcaaatggcgacatataccaagtctgctctgcccgctctatgaatcgttcatacatgtctttctctgtttcccatttggtcttgatttgtgtgtagtgcgcttcgatctcttgctctgtgatatccatcatcacttcagtccgctgatgaagtcttgcaatctcttgaaacaaatattcatgtttatcgtcctgctcttctctcttttcattcgtcagccaaggcatgagatagtatgcgtactgactttcacgatgacttgagaaaaaagaaccgctcttcgtccgataaatcggcacaaaagagcgatagccctttgattctagttcaagcatttgctctgtaaactgcatatgtcgactggcttttactcgctttaaggcaaacacgccctgctttgtatatactttgacgacagcaggactgacaggttcaacgtattccgcctcaagcccgtattcgtataggacagattggatctcatccacgttcactcaccacattttctcgatcggtcatctcttgttatgcattgcttttttgatattcaggaatataaagaatctgcccttcttcaagctccgcatccaccgataatgaatttgtgcgaagaagctgctgcacattcaactgatatcgctcacaaatacgatcgaccgtatcttcttgctgaactatacatattttcatgcgagaaaaatcttcctcctcctgcttagcaaacagctttgttaaataaagagagttctcactgcccgacgtttctctcacgtcttcttcaaatgcctcttcttcttgagctgactcatatacttttggtgcttctcgttcatataaccgtccaagctggtacgtgtcgtcccgcgcctcttcctcttccacgtgataagcgggtgattcaaatacaggatatggctgaaccgtttcttcctgctcttcggttatttccgaatcttttctcacttctacttcaaaaaacgtgtccttccgttcttcttcatctaagagcttaggcggttcaaaaaatggtggttcttgcacctgagcttcaggtaaggagcgataaccaagcgccacttcttcttggctccccgtttcctcctgttcttctagttcttcggtttcttcttccctactcaccagctctatctcaatttcttcttcctgttcctcttcttcggcgcgcgtgtcatgctgtaatacagcctgatcctcttcaatctcatgttcatagtcttgtagctcttcttgctcttcatcttctggctgcagctgataatcgtaggtcacgtcgccatattcttcttcaaaccgatgaacaaattcatacggctcctctacaggcgcttgaggcgtttcctcgtctaaaagaccctcaatcgctagatcagcttgaatggtgagcaaacgattttctgtcagctggtaatcaaacgcatcaataaacacaaacacatcatttaaatgactgattttgtttttaggaatcgtgatatcgactgggaattgatgcagaagctccgccgtcccatcttctctgaccttcacctcatcagcttctctgtatgatgatgcataggaactcaattcacccaatagctcctcttgatttatgttgtattctcctgttagctcgagtgaacctctaatcgaaacataatcattcacttcttgaacgagaatgtcaggatcgagagaaatagacagcagctcactgacttcctgtccgcttttgaaatagatggattcttctactgaaaactgtaatcgattattttgagacaagtcggtgtcctcctttcatctaatccttcaaaataaaattagatgtcaatacagatgtatgtgagcggcagtgaaaatatgattggttttcagcaacacaaaaaagccgatatatctccatatcggctttcgtttattaacgtagtttttgaaatactttttccactgtctcaatcgtatattcgatgtcttcatctgtgtgggctgttgataggaatagtccttcgaattgagaaggtggaaggaagatgccgtgatcggccatttccttataaaattcagcaaataaagcgagatcagcatttttagctttgtcataattgaccacttcttcatctgtaaagaagaatccaatcatcgaacctgcacggttaaacgttaatggaattccgtgtgcttttgctgcatttgaaatgccttcttccagccggtctccttttcgtctaaactcttcataagactcaggtgtcagctgttttaaggtttccagacctgctgtcatcgcaagtgggttaccagataacgttcctgcttgataaattgggccgcttggcgcaatttgtctcataatatccgctcttccgccataagcaccgactgggagaccgccaccaatcactttaccaagacacgtcagatcaggtgtgatgccaaagtagccttgtgcgcagtgataatccacacggaagcctgtcatgacctcatcaaaaatgagtaaagctccgtgttgctccgtgatatctctcagcccttgtaagaaaccgtcttgcggagggacaacgcccatatttcctgcaactggctcgacaatgacacctgcaatatcgtctccaaactcctgaaaagcaacttgaatgctttctaaatcattgtaaggcactgtgatcgtattgcttgcagtcccttcaggtacacctggactatctggaagcccaagcgttgcgacgcctgaacctgctttaatgagcaaagaatcaccatggccatgatagcagccttcaaatttcacaattttatttctgcctgtaaagcctcgagctagacgaagcgcactcatggttgcctctgtaccagagctgaccatacgaatgacttcgatagaaggaacccgctctgatacaagcttagctaattcattttcaactaatgtcgaagcaccaaagcttgtccccttttctgcaactcgctgaatgctttcaaccacacggtcattcgtatgccctaaaataagcggtccccatgataagacataatcgatgtattcatttccatcaatatcatagatcttggcgcctttgcctcgttccataaaaatcggatctgtgttcactgatttaaatgcacgtacagggctgttgacaccaccaggcattaaatgctgcgcttcttcaaatgcttgctttgatttttcatagctacgtcccatttcaacgtcctcctgtctatccgttctttattctgagagccattttgctgcatcttttgcatgatacgtaatgataagttctgctcctgcacgtttcatgcttgtcagcatttcaagaacaagctctttttcagaaatccacccattttgagcagcggctttgaccattgcatattctccgctcacattgtaagcaacaacagggagtgtaaattcatttttgacatcacgcataatatctaaataagaaagggatggtttcacaatgaggaagtcagctccctcttctacgtcagattgcgcttctcttaatgcttctaaacggtttgcagggtccatttggtatgttttacgatctccaaactgcggtgtgctatgcgccgcatcacgaaacggaccgtaaaacgcacttgcatatttcacagcatatgacatgacaggtacatgaataaagccagcttcatcaagcgcctcacgaatggcaaccacaaatccatccatcatatttgaaggcgcaatgatatctgcacctgcgctcgcttgactaacagcagttttcgctaatagctgaagagattcatcatttaaaatttcaccatcttcaacaattccgcaatgtccatgatctgtatattggcataagcaagtgtctgcaatgaccacaagctctgggaaatgctttttgatctcaagcgttgctctttgcacaatgccatggtcgtgatatgcttcactgcccacatggtctttatgatctggaacaccaaatacgataattgatttgatgcctagatcgacaagctcttggacttcttcttttacaaggtccactgaaatgtgataaacacccggcattgaagggacttcttttcggacattttcgccctctacaaaaaagatcggataaatgaaatcagatggtcttaaaaaggtttctctgactaattctctcattcctgcgcttgtccgcagtctgcggtgtctgttaaatttcatcattgattcaacttcctttcagataaacggcacatcaattcaagcattccgtctatcgtataagtatctggggtttcagaagaaatcccgtattgaagcagtgcctcttttgtcagaggaccgatcgtcacaaaacaggtgtcagaagcagccagcttcgctgcatctgcctccatggcatgcataaatgaatggacagtcgatgagctcgtaaatgtaataaaatcaaatgattgcttcgtcattgccgttttaagagcggcaatcccttcctcatccttaaccgtttcatataaaatccattcttttacttctatgccaagtggcacaagcattttcttcacgacatctcgagacaggtgtccttttgctacaaacacacgctctcctggatgcacatggtcaagcagcgcatctgcgagctcttccgctatgaatcgttctggtactacgtccaccttcaagccgtgctgctcaagataggcagaggttttctcacctaccgcagctactttcaaatgggataaacttttatgtaaatgatggtcctctatgtagctcagaaaaaaagacgcaccattcacactcgtgaaaacaagccattggctattttctaagtcctttaaaaaggcctgcgctttttcatttgagagcgtaggctcaaaccgaataagagaggttaaaacagcatggccgttcagctcttcaaccttctgctgaaacacacccgcttgacgttcatttcgagtgacaagcaccgtctgtccgtgaagcgattggcctatggtcattgggaggacagatcctttttcaccttgtcgattaaatcctttgctcccttatcagccatctgcttcgcacatgctgttccaattgcctcagggtcagtgcctgatacagtttctcgaataatcgtgtgtccatcagcagatgccacaagacccgtcagttcaatttcatcacgctcattcatcgttgcatagccagcgatcggcacctggcagctgccatccatttgtttgaggaaggctcgttcagcgagaaccgttttctttgtgtattcattcgtaaattgagcaaggatctgcaatagctcttcatcatctccgcggcactcaattgacaaagcgccttggccaactgcgggcaggcaagtctcaggagacaaaaattcagacacgacctctttgctccagcccattctggacagaccggcagccgctagaataatggcatcatattcttcatttttcagcttttccaatcgtgtatcaatgtttcctcgaatccatttaatgttcagatctggtctttcttgaagaagctgggcactgcgccgtaagctgcttgttcccacaatagcaccattcggcagctcgtgaagacgcagatgatccttcgaaataagagcgtcccttacatcttcacgctcaggaatacagccaatgactaacccttcaggaagagcagccggcatatccttcatactgtgaacggccatatcgatgtcgtgattcagcatcgcctgttcaatttctttgacaaacagtccttttccgccaacctttgataaggttacatctaaaattttatcaccctttgtcacaatctcttttatttcaaaagaataagaagggtttagttcagacagcttttgaatgacccattttgtttgtgtaattgcaagcttacttcttctagaacctactttaattgtacgcaattcgtcttcctcccgacaatgcccttaagactcatcattatttattgaaaccaatgaaaggttgataagctaccaagcagaaaataattgatcatcagcacaaggaatgaaccgacattccacagtgccacgactttgccctgcatatttctcaccaatctgatatataagtaaacaccatataaaaacagcataataaacgaaccaagcaccttggcatctgtccagtacaacgtatcatacgaaatatatgcccaaatgatgccaagaatcaaactaagtaagagcatcggcacgccaataatgtttaatacgtatgccatatgatcaagcttcgataaatcttcaattcttagaagccatttcccccattttttctttttcagcaaacgatattgaaagagatagagaaaagagaaagcaaatgaaagtgaaaaggcaccgtatgataaaatcgccatcgtaatatgaatcacaagcaactcactcgtcagcttccccgttagttctgctgagtgaagatcagatggtgtaaaggtgtgaattgccatcaaggaaaaaccgatgacatttgtaaaaaagacgataaattcaacacgcaagacctttgtgagaacaagtgaaagtgtcacaagcacccacgtataaaaatataacccctctgctacattcaacacagggaatcggtctgtttccatcataatatagaacatgtagactgtttgcagcagccagacaatagaaagcaaccagaaagctatttttccagccttccggttgtgttgaagaaaatctatgaaatagaacaagacacttagtgcatagatcaaggtcgtcgcttcgcctagtctcgctacaatggattccatcatcgcttaatcactcactagcaactgtagcaaggccttgtgccatatttggtttaaacagctgaaatgacccttgctccacctgcatcggctccaccttttgctcttcatcttcaacctgtaaatcaaagatttctttgaagagtaaaagtttttcctctgcattcggctctgcggcaatttcttttgcctttaagataggatctttcagcatttgattgataatgcttttcgtatgtttatttaatagcttcatttcacggtgtgtgagattcggaagctttcgctcaatactctgcatcgtatccgcttgaatcgtcagcgccttttctctaagtgcagaaatgacaggaaccacaccaagcgtattcagccattgcttaaattccacaatttctgcttcaatgaggagctcaacctgctcagccaccgcacggcgttcttttaagttagctgccacgatgccctcaaggtcatcaatgtcatacaaaaaagcaccttctacttcagaaatggctggatctaaatcacggggcacagcaatatccaccataaatagtggtctgcctttccgctttttattcgcaccttcgaccatttcttttgtaatgacaaattgtttcgcaccagtggagctaattaaaatgtccgcttcagataatgttttttccaattggtttaagcttttaggctctcctgaaaaacggcctgccaattcttttgctttctcatatgttcgattgataaccgttacttgaccaatcccttgaccttgaaggttttgagccgctagttcgcccattttacccgcaccaagaatcaggacatgtttatcagaaagacgtccaaagatttttttcgcaagctcgacagctgcatagctgacagacacggcattagacgcaatgtctgtttccgcatgagagcgttttgcaacggtgaccgcctgtttgaataaataattgaaaacggtaccaatggtcttctcctcttgagctactttaaagctagagcgcacttgaccaagtatttgtgtttcgccaatcaccatggaatcaagtccacaggccacacggaataaatgctcgaccgctccatcattttcatagaacttcaaataaggcgagacatcttccttttctaaaccgaaccaatcagctaaaaatctttttatataaaaccgtccagtatgaagctgatctaccactgcgtagatctctgttcgattacatgttgagatgacgatattctctagaatgcttttttcttctttaagcttggacatcgctgttccgagctcgctcggttcaaagctcagctgttcccgtatctcaacaggggctgttttataatctaaacccacaacaagaatatgcataacttcagcttgcacccccaacgccctgtctaatttataataattacaatatagaatttattatttataatgattataacatatattcatttttagctggatgaaaattgtgaacagatttcaaaaatgttgtgatatagtagaaaaatgttcgacacccattatgccatatcatcacttcaagcaatttaccagatttggcgcgtgcggacaaatgatctgcttaaaagaaggtgacatctttgaagaagaaatccattttgctgccgctcactttgctggctgtagcgctatatgccattctctcaggaggtcaatttgacatttggaaggatcaagagaaatggtatacactcgtactgctttttggccttgctttcttatatcaaggaaagaaggagcaagaaagcgctcatgtgtttatcggtatgctgatgacgggtctttcgctacactttattctccagccaaaattggactactggccagacacatttacgatgatcgtattcatcgttggacttgctctttttgtgaaatcatctcagaaaaaagaatatcgtattgaaagtgttgttctcattgcactcggtctgttcctttatttctttcagcaaattacaaagcagctaagttccttttcgatccctacttccggttttgaattgtactggccttatgtactgattgctgtcagtctcctcttattatttttaaaaaggaaataacttatacaataaaaaggcatctgctcatgacagatgcctttttttagttattaatcttcgcaagaatggcattccaggcttcgtcttttcccttttttgtttcagaagagaataggactagttcatcagatggggcaatatcaagcgtctgtttgacgactttcgcatgtttttcccatttgccttttggaattttgtccgcctttgttgcgatgacgatcacaggaactccgtaatatttcaggaattcatacatgttcacatcatctactgatggcttatgacgcaggtccacaatttggacgactgcttttaattcttcacgcattgtaatatacgtttcgatcattctaccccaggcttcacgctctgtttttgacactttagcaaagccgtagcctggaacgtccacaaaatggagcatatcattgatgatgtagaaattaagcgtttgagtcttacctggtttagaagacgtacgcgctaaatttttacgattaatcaatgagttgatgaacgaggacttcccaacatttgatcgtccagcaagagcgatttcaggcagtcccccgcttgggtactgctctggttttaccgcactaatgacgatatctgattttgttactttcatcttccctctcctaccaacgctttctcaagcacctcatctaaatgcgagaccggaataaaggttagtccttctctcacactttcaggaatatcatcaatatccttctcattgtcctttggaagaataatggttttcagtcctgcacgatgtgcgcctaatgctttttcttttagtccgccaattggaagcactcttcctcttaacgtaatctctcctgtcatacctatctcttttgacacaggtcgtcctgtgagggctgatacaagagccgtcgcaatggtgataccagctgatggcccgtccttaggaaccgcaccctctggaacatggatatgaatatcatgcttttcattaaaattaggatcaatgttcagttcatctgccttcgaacgaatataactgaatgccgcctgtgcagattctctcatgacatcaccaagcttacctgttaacaacagcttgcctttacccggagaaagtgatacctcaattgacaaggtatctccgccaacagtggtatacgcaagtcctgtgacaactcccacttggtctgtcgtttcagcctgaccataacggtaaagtctttttccaagaaattcagataagttcttttccgtcaccgtgatacgtttgcggtcttcagccacaattgctcttgctactttacggcatatcgccgcaagctgacgctctaatccacgaacacccgcttctcttgtgtaatagcgaatcgtatcataaatcgctgcttcacgaagctgcaagttccctttctttaatccgtgctcctttagctgcttcggcagaagatgatctttcacaatttctgctttttcaacctctgtataccctgcaatcgtgataatctccattctatcacgaagtggacctggaatggttgctaaattgttggcagtagcaataaataacacttgagacaaatcaaatgtttcttcaatatagtgatcgctaaagttatgattttgctctgggtctaagacttcgagcatcgcagaagatggatcacctctaaaatcagaggacatcttatcgatttcatctaaaaggaagactggattcatcgttcctgccttgctcattccgcgaataatacggcctggcatcgcacctacatacgttcttctatgtccacgaatctcagactcatcgcgcacaccgccaagggaaacacgaataaactttcggtcaagtgatttggcaatcgatttagcaagtgacgttttccctactccaggaggtcctgctaaacaaagaatcggtccttttagtgaattggtcagcttctgtacagcaagatattcaagcacccgttctttgaccttttccagcccgtgatgctcatcatctaaaatttcacttgcaagctttaaatcgagacgatcttctgtatagatgccccacgggaggccgatcagccaatcaatataatttcgaatcacagagctctcagcagagcttgaaggaattttttcataacgattcaattctttaagcgccgtttcacgaacagaatctggcatgctcgactcttcaattttagacattaaagaactgacttccccagttttcccttctttgtctccaagctctttttgaatagctttcatttgttcacgtaaataatattctttttgcgtccgttccattgaacgtttcacgcgctgcccgattttcttttcaatctcgagtacttctttttcattgtgaattaagctgatgacccggttcagccgttttttgacatccactgtttccagcacttcttgtttgtcctttaatttgagcggcaggtgggaagcaacgatatctgccattctcccaggttcttcaatatccgtcactgttgcatatgtttcagctgagattttcttagaaatttttatgtattgatcaaagtgatctaacaatgtacgcatgagtgcttctgcttctgcgtcctttaattcttcttctgccaattctttaatgtcgacagacgtatagtcctcaagctccacatatgattcgatctgcgctcgatttaagccttcaacgagtacacgaatcgttccatttggcagcttcagcatttgtttaatttttgtgtaggtgccgactttgaaaatttcctcttcacctggttcatctattgaaatttcccgctgtgttgctagaaaaatcatatgatcgttcatcatcgcctgttctaatgcttgaacagacttttcacgtccaacgtccaaatgcaagaccattgttggataaacaagcaaacctcgcaatggaaggagcggaacattctttttgatttcatctgccatgttgattgacacctccgtcactagtatgaatcattataatatacctgtttcagtcttgtacaatgtaaaagacttgagaaatgttgatcttaccgtagtataccctttctttttatcttgaaaaagaaaaaaagatctatttcactaaaaaatccccatatatgatggggattaaacagattttcttttcatttcgtcttctagtccatctttcttctcgtctggtgggttgaccagacactgatccagcacctcttggaagtgcttcacaggcacaatagtgaccccttcaatctcttttaagatcgactgctggttgtcataaggaataatgacagttgtggcaccagcctgcttcgctgccttaatcttcggtatcacaccaccgatcggcttcacctgaccttgcaatccgatttcacccgtcatggctgtcagatgatcaatcggaatttgatgtatggctgagaagattgcggtcgccatggcaattccagcagacggtccatcaattggggcaccgcctggaaaattaatatggatgtcatattcatttgtccgaatgcctaaatttcgaagcaccgttaatacattttcaactgaccctttggccatactttttcgtctaatggatttcgattgattgccaatgctttcttcttctgcaatccctgtaatattgatactgcctttttcaagcgccttacagatattcacttcaatctcaagcagggcaccgctgtttggtccatacacagccagtccattgactactccgacttttggcttttccggtactttttgttcatatcttggtgtcagctggcttgaatgaatgacccattcgacatcttcaatcgtaatgtctttccggttttctgtgaccgccatacccgcggcaatctgcaccatgttgaccgcttcacgtccatttttcacataggaggttaacaggttgagcccttcgtcacttaattccttttgaattttttggacagcctttgcagcgacgattttcagttcatgctggtcaaggtctttaaagaaaatctccagacatcttgaccggatcgctggtggaatttcgtcaggtgttcttgtcgtggcaccaatcaatcgaaaatcggccggaagtccattttggaaaatatcatgaatatgattcgggatttgggtattttcttcactgtagtaggcactgtctaaaaagactttccgatcttccaacactttgagcattttgttcatttggatcggatgcagctcgccaatttcatcgataaataaaacaccgccatgagcatgtgtgacggctccttgttttggctgcggaatgcctgcctgccccattgctccagccccttggtaaatggggtcatgcacagaaccaataagcggatctgcaatgcctcgttcatcgaatctcgcggttgtggcatcgagctctacaaagaccgcatcttttttaaacggagaatcagcgtgacgcttcgcttcttccatcacaagacgggcagcggctgttttaccgactcccggtggtccgtagacgataacatgctgtgggttcggcccgcatagtgccgcttttagtgcacgaatgccgtcttcctgccccacaatatcttgaaacccctttggccggactctctctgataaaggttcactcagcttgattgaccgcatctttctgagtgcttccatttctttctttgactccttgtctatcgtcaccttttgtgtgcgctgatttcgcagtaagttccaaaagtacagcccgatgacgataccaaagaacagttgtatgaataatacgattcctgtccagctcaatcggtgctccctccttcatctatcgtatgtattggtttctgtctgctagtatttcctagagctggacggaataaacacaacttacacgataaataaaaaactcctgaatcaaaaagatttaggagtgagattactcttatgcagatgttttcgtatctttattgacgactgtgccgtcctttaacacaagacgcggcgactcgccatcagcaaccgttgcaccagtgatgacacatttttcaatatcgtcacgtgatggaaggtcaaacatcacatcaagcatgatgccttcaataattgaacgtagaccacgagctcctgttttacgctcaattgcttttttcgcaatttcgctaagagcatcttcttcaaattccagctctacatcatcaagctcaagcatttttgtatactgcttaacgagtgcatttttaggcttcgtcaagatctctacaagcgcttcttcatctaatggctctaggcttgcaataaccggcaagcggccgatgaattctgggattaaaccgaagcgaagcaagtcttctgggagtacttttgataaaagaacttctttttcaagatcttcgattttattttctgcaccgaatccaatgactttttgacctaggcggcgtttaatgatttgctcaatgccgtcaaaggctccaccacaaataaagaggatatttgtcgtatcgatttgaatgaattcttgatgaggatgcttacgtccaccttgaggcggtacactagcgacagttccttcaagaattttcagtagtgcttgctgaacaccttccccagatacatcacgagtgatagaagggttttctgattttcttgctactttatcgatttcatcgatgtagataatgcctttttccgctttttctacatcataatcggctgcttggatcagctttagtaaaatattctctacgtcttcaccaacataacctgcttcagttagtgatgttgcatctgcaatcgcaaatggcacatttaaaatacgagcaagcgtttgagcaagtaatgttttaccgcttcctgttggcccaatcatagagatattacttttcgaaagctcaacgtcatcaatcttgctgttggaattgatccgtttgtagtgattataaaccgccacagctaaggatttcttcgcattttcttgaccgatgacatattcatcaagaatctcccgaatttcatgaggcttcggaacatccttgaattcaacttcttcctcagtgccgagctcttcttcaactatttccgtgcaaagctcgatacattcatcacatatatatacgccaggtcctgcgaccagtttacgcacttgatcttgcgtttttccgcaaaacgagcattttaattgacctttttcctcgttgaatttaaacattctttcaccccttattcttcttcacttgcctgtagctaacagtcagctacctttctgggtccagtatgtatgcattttaccatactttcctaaaagacggtaatgatgtgtttctaacactgcacattgagatatgtataacagaaagatgtgacttacactatcgtttccaaaagaagcgatgataagtcaaaaattgtacaaaacaaggcacgagtcactcgcgccctgttttattattatgcaccatattaacggttttctacaagaaaatcaattgctttacgaacttttagatcttctttcattgcgtcagtagatccaatcgcttgtttaatattttcaattggcatgttgtatgcttcagccatttttgaaagctcttcttctacttcttcatcagacacttgtaagttttctgcagcagcaattgcttcaagtgttaggttagatttcacgcgtttagcagcatcttctttcatttgctctttcagcgcattttcatcttgtcctgagaattggaagtaaagctcaaggttcattccttgcatttgaaggcgttgttcgaattctttcatcatacggtctagctctgtgtcaaccatcgcttgtgggatgtcaacttccgcattttcagaagctttctcaactagctcttcacgaagtttaccttctgcttcgttttctttcgcttcttcaagacgtttctttgttttttcagttagttcagcaagagtttctacttcttcatcaacatctttcgcgaactcatcgtcaagtgctggaagttcttttgctttgatttcgtgaattttcactttgaatacagctggtttacctgcaaggtcttcagcgtggtattcttctgggaaagtgacttctacgtctttttcagcgcctgcttcaagaccaactaactgctcttcgaaaccagggatgaatgaaccagaacctacttcaagagagtagttctcagcttttccgccttcgaatgcttctccatcaacgaatccttcgaaatcaagaacaactgtatcgccgttttcaattgcgccttcttctttgacaacaagctcagcttgacggttttgcatgccttttaactcttcttgtacatcttcatcagtgacagtagcgtcgtctttttctacgttaagacctttgtagtcaccaagtttcacttcaggtttcactgttacttttgcagtgaagattaagctttcgcctttttcgattttctcaacatcgatttcagggcgatcaactggctcaataccagcttcgtcgattgcttttggatactcaactggaagaagaatatctaatgcatcttgataaagagattctacaccaaaacgctgttcgaaaagaccacgtggtactttccctttacggaatccagggatcgatacttgcttaacaactttcttaaacgcatcatcaagtgctttgttaaatgtttcagcatcaacttctacagttaagacgccttcgttaccttcttgtttttcccattttactgacatgtgtgtttccctccaaaaatctattcagattgtgcgttgttacattctaaagcatcataaagacttcgtccaattaaaaaccacgcacgccgctaaagaagcggtattatgtatacaacatttgacttgattatacatatcgtctttcaaccattggaatcgacaactgcacgatatatgcacaaatacaaccattatattataacataacaagtccgtctttcaactaaatcgacaaattacaaataagaaatttcttcaatatctttcagcattgtgcaagcttctctcagctctcgttcatcaaattcatacaatagatgcaattcttcgaggtcaatctcgatcccatgcatttcatagccgactttatgaagtgctgctgcccagagattcggatctgtgtatttaggaagaaatggatataggacaaataagtgccggcgccataactcttccacgccttggtaaagggttgggttctcattgccgagtgtgtcatcgagcttacgaaggacttgctgaagcagcggcatttgctctggtttaacagcctcagaaggaacaagcgttaacgaatcaccgaacttcgtcacatgaaccggctttgccacatcatgatctgacagaagctgcaggatcaatgatttgaccaaagggtttccatcaggcttttgtaggatcgtatttaatagacccatgtgcggcgtgatgtttcggtctttcagcgaatggatgaactgcacctgctcttctggccgctcgagcatatcatctatattgatttcgccgccgtcatcatcatcttcatctaaaatctgttcaggcgattcgatcatttttctactaaattcgagcagcttgtaaaaatgctctgcgctttctgctggaagatggttttcctcaagtaccgcttcgattgtctgcttcacttcttcatattctttcagctgaatcaagatagtcatatacacttgaagcacggtgaagtaatgaccatatccctcatgcagcatcttttcacacacacgctttgcatcctgcagctcgcccagctccagaaaacaaatcgccataccgagatgaatatcggtttcttcatcgtcatcataggattttgcttctgaaaacaagtgaagcgcctcttgatactgtttatcttttaatgctgccattcctttttcaatcagtctttctttcagaccaggaaacaaaatgacattatctttcttcttgtcatgtttcatgcttacgttcctttcgggcgcatattttttatcagtttaccaacgaaggttagtaaacacaagtaacgaaaggttttcatgcaaaaaagaagccgtcacacctcgggcggacggcttcttgttgtttacgcacgcagccagctgctgcgcttatcttcaaatgcttgaatgtcatcttctagtagtaaagttaatgagatctcatcatagccattcaggagcatttctctccagtgaggatccacatcaaaaggagtgatattcccttcgtgatcttctatttgctgtttttcaagatcaactgtcatctcataccctttgttctcatatgacgcaacgaatgttttccacacatcataatcaagacgaatcggaagcatcccatttttaaagcagttttggtgaaaaatatctgcgaatgatggtgcgatgacaattttgaaaccataatcatcaagtgcccaaggggcatgttcccttgatgatccgcagccaaagttttctcctgcgatcaaaatggatgctccttcataaatcggctgattcagttcgaaatcaggattagggctgccatcggctaagtaccgccagtcgaaaaaggcaaaccggccatatcctgttcgttcaattcttttcaaaaattgcttcggaataatttgatctgtatctacgttgatacggttaagcacagcggcttttcctttgtgtgtgactaaaggctccatctatgacaactccttacacgactgttttctcttgattaaacttcctgacatcgacaaatcggccatgtattgcagccattgcagccattgccgggctgacaagatgcgttctcgcaccttttccttgacgcccctcaaagttacggtttgatgtagatgcgcagcgttctccttctggtaccacatcgttattcatgctgagacacatactgcagccagattctctccattcaaatcctgcttcaaggaagatttcatgaagaccttcttcttctgcctgcaatttgacgctttgagagccaggcacgacaatcgctctgacatgatcggctaccttttgtccttctatcatagaagctgcttggcgtaaatcagtcattcttgagttcgtacatgagccaataaacacatgctcaatcgtaatatcttcaatacgctgatgaggatgaacacccatgtattcgtacgcacgaatcgcttctttttgatcatcttcttgcgcaaaatcttcaggtcctgggatggatgcatctacaggcagcaccattcctgggttaattccccatgtgaccattggtgaaatctcattcccatctaaaacaatcgttttatcataggttgcacccggatctgttttaagttcttcccattctttaatcgctgcttcgaagtcttctccctgcggtgcatatttgcgtccgcggcaatattcaaaggtgacttcatcaggtgcaatcaatcctgctcttgcgcctgcttcaatcgacatattacaaacggtcatacgttcatccatcgtcatgtttctgaatacttccccagtgtattcaatgacataacctgatccaaacttcactccatgcgcaccaatgactgctaaaatgacatctttggccgttacccctttttgcagctttccgtctactctaatttctaatgttttcggacgctgctgccaaagtgtttgtgtggaaagtacgtgttcgacctcacttgtaccgattccaaaagcaagtgcgccaaatgcgccatgagtggatgtatgactatctccgcaaacgattgtttttcccggaagtgtcaaaccaagctctggtccaacgacgtggacaattccttggtctacactgtgtaggtcagctaggcggacaccaaattcagcacagttacgctctagagcactcacttgttttttagcaatctcatctttgatcacaaatcgattcacagtcgggatgttgtgatccatcgtcgcaaacgtattttgaggtcttctcaccttgcgccctttttgtcttaatccttcaaacgcttgaggcgatgtcacttcatgcaccaagtgcagatcaatatataaaaggtctggtttcccctcgccgcttttgacaacgtgctgatcccatattttttcgatgattgttcgaggcataacccttttcctccctctacctaattccacaagattctatttatacaattgttttcacgcgctgcttaagtgcgtctacaactgcgtgagtgatgtcttcagttgtttgatacgttccctcttttgccgataaatcctttgttcttttgcctgaggcaagaacagtttctacagcttcttctatagcagccgcttcttcttctaacgcaaaggaagttctaagcaagcttgctgccgataaaatagttgccagagggtttgcgacgttttgccccgcaatatcgggtgctgatccatgaatcggctcatataaatgaaggccggtgcttgatagactagcagatggcagcataccgagtgatccagtaatcattgaagcctcatcacttaaaatgtcaccaaacatattctctgtcacaatgacatcaaattgtgcaggcttataaatcagctgcatggcggcattatcaacgagcatatgctcaaattcaacgtctggatattgagaagccacttcttctaccgcatcccgccatagtttactagaagccagaacgttcgctttatccacagacgttacttttttccgtctcgttaacgccatgtcgaatgcttcttttactacacggacaatctcttcctttgtataaagaagcgtatcaaccgcagcttcttttccttcttcatctgtatagcgctcacttggttcaccaaaatagagaccgcctgttaattcacgaacgatgacaaaatcgactccgttaatgtgatcctgttttaacggtgacgcctcgcttaaactatcgaacactttgacaggacgaatgttagcaaataagtccaattgtttacgaatggcgagcaagcctttttctggacgaagctctggtggattttgatcccatttgggtccgccgactgctcctaataaaatcgcatcagcgctcttgcatacatcaaccgtttcttttgggagcggattgtttttttcatctattgcgataccgccaatgagcgccgtttcgaattcgaattcgtgcctaaattgagccgctgtctctttgaggacagcgacagctgatgtcacaacttccggtccgattccatcgccgggcaaaagtgcaattttctttttcatgaggacctacctcctttcctatgagatcgcgtgatgtttctcaatttcaatgagatttgatttaaagattaaatgtctgtttactgcattgacgtaggctttcgccgatgcttctagcacatcttgcgctacaccgcgtcctgctgtttcttttccttctattgaaacagtgacatatacttcggctagtgcatctctgccttttccatttgattgaatacggtagtctagcaaatgaattctttcctccatacagcgctccagcgtgttgtacacagcttctacactgcctgcgcctgtagctgcttcttgaatgacttcttgcgtttcttggtttttcagagaaactgttgctgttggcatttgttctgttccataatgcacttgaagactttcaaattcgtagccaatttttcggtctgctactttttcttctaatataatagagatcaaatcatcatctgtgatttcttttttcttctccgtcaagttcttgaaggtttcgaagaacttattgatttcttcttctgttagtttaaatcctagagttttcatgcggtctttaaacgcatgtcttccggagtgtttcccgaggacaagtacatctgttgtcacgccgacaagctctggagaaataatttcataggttgttttttctttgaggaaaccatcttggtgaatacctgattcatgtgcaaatgcgttgtttccaacgactgctttattacgcggcacaatcatgcctgagtatttgctcactacatcacttgtacgcttaatttcattcaattgaatcgttgattcgacctgatagaagtcttttcgaatgtgaagagcgactgcaatttcttctaaagcagcatttccagcgcgctcgccaattccgttgacagccgtttcaatttgatctgctccattttcaatggctgcaagtgagtttgctacagccatccctagatcatcgtgacagtgagcggacaagttaacacggtcgatatttggaacgtgttccttcatatatttaaagatattaccgtattcttttggcgctaggtacccaactgtatctggcaagttaatgacactcgccccagcgtcaatgaccttttctacaatttctgccaagaaagcaagatctgtacggcacgcatcttctgctgaccattgaacaactggaaaacgttctttcgcatatttcaccatggagacagcttgttctacgacttcttcacgtgttttctttagtttatgcttcaggtgaatgtcagaagtggcaataaagacatgaagccttggctccactccatcttttaatgcttcccatgcagcatcaatgtcacctttcacacatcgtgcaagaccagcaacagaacagtttttaatcgttcttgctatttcttgtacgcctaagaaatcccctcgggatgaagcgggaaaacccgcttcaatgatattaaccccaaggcgctcaagctgctttgcaatgattagcttttcttgtgcatttaagttcactccgggtgattgctctccatctcgaagtgttgtgtcaaaaaaattaatttttcgcaccgacgctcaccgcttcctttttctttccttgtttgacgaaaggcatcatttcacgaagctttcttccaacaacttcaatttgatgctcattttcattagcattgatcgcattgaaacgtggacgattcacttggttttcaacaatccattcttttgcaaatgttccgttttggatatcagtcaagactgctttcatcgattcttttacgtttgcatccacaacgcgtggtcctgatacgaagtcaccccattgtgctgtatcagagattgaatatctcatgccttctaatccttcttcgtacataaggtcaacgatcagttttagttcatgtagacactcgaagtatgctagctctggctgataaccagcttctgttaatgtttcaaatcctgcttttactagtgaagtaagacctccgcaaaggactgcctgctcaccgaatagatccgtttccgtttcttctttaaatgttgtctcaagaacgcccgctcttgctccgccgattgcttttgcataagcaagcgctttgtctttcgcttgaccagatacatcttgatagatagcaaatagtgcaggtacaccagcaccttgctcatatgttcttctcacaagatgtcctggaccttttggcgctacaagatacacatctacgtcacttggaggaacaatttgatggaagtgaacgttgaatccgtgtgcgaaaacaagtgagttgccagcttctaattgatctttgatttcttcgtcatatactttcttttgctgctcatctggtagtaataccatcacgacatctgcttgtgctgccgcttcttttactgtgaatacttgatggccgtcttcttgtgctttcgtgtaagatccgccttttctcacgccgacgatgacatctacaccgctctcttttaagttcaatgcatgtgcatgaccttgtgatccatatccaatgatggcaaccttttgaccatttaatacgttttcttgaatatcaccgttataatatacttttaccatttgactctctccttttgtttagacaattgaaattgttttattttgttgcggcttttgctgattatctctcgcaaaggccgtggtgccagttctggcgacttctttaatgccgtatggcttaagtaattcaatgagtgcttcaatttttgaagactcacctgtcacctgaatgacgacactctctctgctcacatctacaatagaagctctaaacggttcaatgacccctgtgatctccattctagatgctggtgcagaaacgacttttatcaaagccagctctcgctggacgattgattggtttgtaatgtctgttactttgagtacatcgatttgtttgttcagctgttttgtcagctgttcgatgtctttttcttggtctacatggacgacgaacgtgatgcgtgatacatcttgaacctcagaatggccgaccgtaatgctttcaatgttgtagtgtcgtttagtaaaaaggccagtgattcggttcagtacgcctgatcgatttaatacagtcaacacaataattcttttcaaggtttcacccccaccatctcatgaagtcctttccccggtgctaccatcgggaatactttttcatctctcgctacattgacatcgatgaaaacaggctctctagaggttagcgcttcttcaagcttttctttcgcctcttcgtctgatgagattctgattcctttaatgccataagcttcagataatttaacgaagtccggctgctctgaaaatttagaatatgagtagcgttcttcgtagaaaatttcttgccattgtcttaccattccaaggctgtgattgtttagaacaatcactttcactggaaggttcagctcacggataacggcaagttcttgaagggtcatttggaaacctccgtctcctaaaatcgccacaaccgttgcctcgtgatcagctaactgagcgccaatggctgccggtaaaccgaagcccatcgtcccaaggcccccagatgtgacccatttatctgcattttcaaatggatagaactgtgctgcccacatttgatgctgtccaacatccgttgccacaatggcttcaccttttgtgaattgatgaatgtattcaatcagtttttgaggtttaaagccctctgcttcattttcaacgtaccagagtggatattcttccttccactgatctagttggtttttccactcgtctgactctccttgcttcccgtcttgcttaatcagctcttcaaggactaacttactgtccccaacaaccgggatatgcgtatgaatgtttttgccaatttcagctggatcgatatcaatgtgggctaccttcgcatgtttcgcaaagtgattgagattgccagttaccctgtcatcgaatctcgcaccgattgaaatgagcaagtcacaatgatgtagagccatgttcgccgcatatgtgccatgcataccagccattcctaggaaaagaggatgctttgccgggaagccgccaagtcctagcagtgtatgagcgactgggatttgctgctgctctacatactgccttaattcttcagatgctttgccatgaagaacgccagctcctgctagaatgactggttttttcgctctgctgacagcttctactaatttgcgaatctgcaaatagttcggctccacttttggctgataaccaggtaaatcaattggctgatcgtattcaaacgttccttcaatgcctgccacatcttttggaatatcaatcaagactggaccaggtcttcctgtcgttgcgatgtggaacgcttctttaatgacgccaggtaattcctctggatttctcacctgatagctgtgctttgtgataggcattgtgatgccgagcacgtctgcttcctggaatgcgtctgatccaatgactgaggttgccacctgtcctgtgaagacaacaagaggaagtgaatcaatcattgcatctgcaattcctgtgactaggtttgtcgctccaggtcctgatgttgcaatgacaacacctggtttgccagatactcttgcgtatccttctgccgcatgaatcgctccctgttcatgtcttggcaggacatggaataacccagaatcataaattttatcgtagatcggtaaaaccgctccgcctggatatccgaaaatgacttctactttttctcttttaagtgcttcaattagcatgagtgcaccgttcatcgtttgtggtgccttagatgtttccgtctccacttgtacatttgtccccatttgatttcctcctctttgtcttgcttcagtcaagtcttttcacccttttctattcaagattgagattttagaccatataaaaaagccttctcaccccacaatgacactacttttcactaggtcaaaggggcgaaaaagctttgtttttcgcggtaccacccttgttcacggcaaattcagctgccgtctcatggacatctttcatccattttggtaacgagtgagcaatgtcactcggtctgccctactatcatttcaagcagacactcagaggtgagttcactttagaaagtaacaccggtttccagctaccaccggctctctgtagatactgactctaaagctactagtcctcttcaacgtttatcgatatctatttagcttgcgtgaatgttttcatctgtaaaaacgactttttctccttcttcaaccactcgcttgcggaattgttcaagaagtttgttagtgtgaatcccaggcttcccttcacctattgtacggccgtcaacctttacaacggcgatcacttcagctgcagttcctgttagaaagacttcttctgctgtatacacatcgtgccttgtgaatggttcttctttcacttcatagcctaagtcctctgcaatctccatgatggcatttcttgtgatgccttcaagagcgccgatataacctggcggtgtatagagcttaccttttttataaataaacacattgtctgcagaaccttctgccacgtacccttgatcgttcagcatcagcgcttcactcacaccggccatatgggcttcgattcggacaaggatgttattcaaataatttaatgatttcacttttggacttagtacatcgggacgatttcgtctcgtcggtaccgtcacaatatcaatacctgtttcatataggtgctttggaaagatggccagcggctctacaatgatcactgtgttggctctcccgcagttgtttggatctaaaccaagatcaccagctcctcttgagacaacaaggcggatataggcatccttcagtccgttcctttcaactgtatgaatcattttttccgcgagttcctcaagtgaatatggaatgttcagcataatcgatctggcggaatcatacaggcggtctaaatgttctttcatccgaaagatatttccgttatacacgcgtatcccttcgaacacaccgtcaccgtataagaagccatgatcataaactgaaattttcgcatcctcttttttcacgagttcatcgtttaaaaagatccactgttccttttggtcttccattttcagtgagcaccctctctttcaaacaaaaagtagttgaattttcagacaccttataatgaagtgtctcacgcttgctctttcgtgtttgtttagcttttgttgaacccatcttacgccgctttccatacagtgtcaacagcatttttaaaattattagacaatttagactaatcaaaattaaatgtatacgcttacacctttgctagacaaggaatgaaaaaacttaaaattttttgtattttttcttcaatttatttactttacctgaacacttttcatttgagaaaccgtttgtcatattttttcacattgttttgaatgaatactggtagattccaacgcttttgattttctttcggtatgcctttctaaagcgttttcctatgaatttatgatagaatgagagcatcttatagaaggagggcaatacatggctaacatcagaggttatatcggaacgtatacaaagggagacagtaaaggcatttatacttttacattaaatacggacaagcagcagattgagaaagtagaagtagctgctgaacttgaaaatcctacatatttaaccgtctcagattctcaaaaatttgtgtatgctgtggtaaaagaaggatcacagggcggcgtggctgcttatcaaatcgatgcagaaaccggcacacttcgtttcatcaaccaagaacttgccgaaggcgcttctccttgtcacgtcagcgtggacagtcaaacaaaaacagcttttacagcaaactatcataaaggaacagcagagatgtatgaaatcgatgctgaaaatggctcagtgatccgcacgctgtcacaggcgcagcatgaaggtactggccctaacgaagatcgtcaggaaaaaccgcacactcactttatgggtctgacaccagatgaacaatttgcagtggctgttgaccttggaacagatggcatttatacgtataagaaagaaaacggcaaattcgagcttgctcatacatttgaaacaaaaccaggcaccggtcctcgtcatatcacattccatccaacgaaacctgtggcatatgtgatgacagagctaagctcagaggtgattgtgcttcgttactttgaagatggtcatttcgaagagatccaaacgattgcaaccattccaagcgactttacagagaacaatcaaggcagtgccattcacgtctcttcagacggccaatttgtttatgcaggaaatcgcggccacgacagcattgcgatttttaaagcagacactggcggccaattaagtcttgtcgagattgcttcatctgaaggaaactggcctagagactttgtgcttgatccaactgaagaattcctcgttggttcaaaccaagaatctagcaacctagtgttatacaaacgcgacaaagaaacaggacgactcactgtgttacaatcagacatctcagtccctcatccagtttgcgtgaaatttttaggataatgaaaaaaagcctccagctgtggaggcttttctttatgcagacggcatcccgccatcttcaagtttttgatcaatcagagacgtatcagttttttcaccgaaccattttgacagcctgtccttcgcttttcctttcacatcatcatcaatgtagaccgctacttgaatcagagcaaatgtgatcgcgcctaaatcatctgtatagccgacaccaatcaatgtatcgggaataaggtcaattggaaggataaagtatccgagcgccccaataataagggtttttgctttgacaggtacttcaggtttttgcaatgtatagtaaagtaatagcacagcatagacaagagagacaccagctttttgtgccgtcttttttaacttttcccaaaaggcatgatcattaaaatgctttttcgaacgcttcaatagttcttttttctcagaacgattcatcatatcgcctccatctacagcatagcccttttcccttcgttatacaagatatctgccatttcgacaaacaaaaagcagcagaaagctgctgcattctactgctctttgtaaaacttttcgattgccttatcgatgtacacccatcctttataagacacatgaatcgtatctttaaagaaataaggatcgtactcatgcttagtcaaatctgcaacttcatacccattatcgcgaatttgacgattgattttctcataatactctgtgcgcccctcttttgggaaaccagtataatcataccatttcccgttaacaggaatcgtcacaaacaaaggcttcgcccctgcctgttttaaaatatccagcatgatttgaaaatctttgtactctggtgattccgcataagagtgatcttcacgggaatccttcatctttttcatgatcggtttcagcttgcggtcaaacagtttttgattaatataaaacgggttgtcccctgcttttttcgcacctaagacacttgcttctttttcaagctcagaccatgtttttcctttgactgaaggagacggttgaagcttacgttcatgccccgatccaatggtatagtacatgtctttcttttgaagcatgccataatacattttggcaataggagaaatcgcgccataagcgaatttgttcccagaaagctctgctttaaaaagctctgtgatgaccatatcgttctttactgctttaaacgtcatgattctcttgatcagttcttttttcacagctggatcaatttctttattataagcgagattcagtgcttgaagcgctgaatagttcggtgcaaagtgattctcgtctgatccccactttacaaaccactgcggagacacgataaatacaagcttcttcccttttagttcatccatatgcgctgcaaagttcatcgcatgaattaatgattgcgatccaccttttccaataagataaggtgtaaacccttgaggattctcatgaaagaaatttgaagggtgatatggatcaaaacgtgatagttcagaagatccatagatcggcaaataagttggatcttttagcatttcatcttgtaaataaagcccttggaacatccccggatctaattctatggctgacttttgtaatttgtcttttgggatcagatgtgagagccatgcatttggtacaagaagaacaccaatgaatagaacagccgctaaaataagcggcccaaaaaaacgctttttcattacttcatctctgccagctgctcagcaatgtgattcggtgtatcccacacatcacgatcaaactctgtaatcggaacagtaattccaagttgactttcgatagccataagtaattctactgtaccaaatgaatctaaaagaccttcgtcaaaaattgcaatctctggattttctttcacaacgtcgtcctgacaaacctctgcaataataccgtatacttgatttttaaattccataattttctactcccttaatcattaatgatgaaatggttttcctgaaaaaatgtaaaatccgaaacaaatcacatggaatgtaataatgatcgacacaaccattgtgaccttgttatccggccaccacttgtgttttttattccatttctcaaataaattgtaaccggacatcacaactgcgtgatatagtccgtaaataatatattgaagtgctagaccatgccaagcacccatcaatagaaagaggacaaagtacccaatatttgatacagccatacggttcttgatccacttcttttttgtcataaagaacacaaatctcataaacacgtagtctctgaaccagaaagacagggacatgtgccagcgattccagaagtctttaatattccggctgataaacggtttgttaaagttttctggtgatttaatgcccatgatataactcacaccaacagcgaacgctgtataaccagcaaagtcaaagaacaaatacatactgtacgcatacatatacgttaactgttgaacaaagtgactgctgctaatgtgatgaatattcatcagaatatacgtgtgaatcaaataaccaataatgaacttatataagaagccgataaaaattttatgaatacccgcgtataaaagatcactgtacgcttccttttcaggcggcgtatccatatccttttcaaaccggcggtaacgatcaatcggacctgatgaaatcgtcgggaaaaagacaatgaaatagaccaaacgatgaatcggaattttcttcttaatcaagccatctcttgtctcgataattaactgaacacctttaaatgttaagtacgagatccctaaaaagctcaaccagttcattggcggcggttgatgcggctgatgagttaaaaagaacggtaaaacctttgatagtacaagcggcaaaatcgatgcaaccactgccatatagaagacagacgccctgttcgctttcaaccggtacgaaaggtacaaccggatgatcaagacttgccacactgtaaataagaagagaagcagcgcgccatgtgcatcctttgagaaaataagcgcgagtgccacaaccgttgcaaacatgttgtagccctgcattcttttgccgcgtagaccaagaatgatcgtcggcaaaagaagaacaccaattagaatgaagaaaaagaatgaactaaacggaatcatagaagaacctctttcgcgattcttttacggtcaaccttcccgtttggcgtcatgtatagctgctcaagatagacaaactttcttggaatcatgtacgcaggcagtgaatccgccatttctttcttaattgcacttgtcagctgatattctttttcaaaagaatgtgctgctggaacaatggctgcaatcaagtactccacatgaccgtttggctggaacggcacaatcacacaagcattgacatacgttgtctcgctcacatgatattcaatttcttcaagctccatccggtatccgtgcagtttaatttgatagtccagacgaccgtggcacgtaatcaaaccatcctgcgccacacctgcgtcacctgtgcggtatgcagggcgcccttcgtattcaaagaatactttctccgtcaaggcttgttcacctaaatagcctctcgtgacgcttggccccacgatgacaatttcccctttttcaccatcaggaagactcttgccttcttcatctaaaatgacgatatctgtatccggtttcgcatagccgactggtaaagaatcgtgctgatcaagaatggcctgcgtgacttcaatcgatgtaatcgcaacagttgcttcagtcggaccatacgtattaaagacctgcgcatttggaaaacgctcaaggagtgcacttgctacagatacaggaagtgcctctccgcagaacaagaaaactttcaactctggtaaaagctcccctgtaaaggaaggatccattaagcacatttgcacaaaggaaggtgttgatgtccacacttcaacgtcagattgaccaagtgctgcaaacatatccttcggcttattcacaagatctttcactaaacagtacagcgtgccgcctgattgaagcgctggatacaaatccattactgataagtcaaaagaaaacggtgcttgatttaagaacgtgcgcccctcaccaattgggaagtctctacacatccactctgtaaagctttctaaattattggctgttacctgaacgcctttcggttttccggtactgccagacgtataaatgatgtaaaacacatcatcctgttgaacccactgcgatgatggcggtgcttctttttcaagagctaaaagcgatgccgcactcttcacttcaatgtgctcttctacatctagtacattctgctcatttgcacaaatcaatagactggcttttgagctttcaataattgagacgatacgctctgcagggattgaaatgtcgaccggaatgtatggtctacctgatttcacactgcctaaaaaagaaatcagcatctctggctccatatgaccgtatacaatgacaggtgcactatctgtagcgaccgcatcgattgcaccagccatttggtctgatagatgccaaagttcatcatatgtgatcgaagcatgttgagaaacaaatgctggctgtgttggtttcgtttgttggtattcatgaatcgtgtgtaatagtttcatagtttaatctccaattaaaaatcgttgtaaatgaatgatcccgtatttgctgtatggaatccgtaaataaagaacaataatagcaaaataagtaagtaaaagcttgtatatcctatccattttacagacttattttctgatagctttttgaatagcatattgataacctcatttcttttgacacttatagagacgcatgaatcattaaaagagtttcatatcaaaccataaaatttttaagaaaatgctaaaaaaatgtcgaaccttagaacgtctcttttgcgcaaagctgtcttattgtaacaaagatttaatgtatttgaaatgaaattcgatcttaaatttgccttaaaattgctgaaagctgtcgaataaacacaaaagccacctagtttacctagatggctttgatttcaattacttcttatatttattgacttcgaacatgagtatgtttttgaacaccacataatccttcttactttcaaagggacctttgttgttgtcatgctcatcaatttcataaaaccctggtccttctccggcatcacgctttttgtaccatgataggaaagcgttgacttctttcatggagaggtcatactctttttgcaaaccattgaccattgtgatgatgagaagagcatcgccgtcttcatctgatgtatcgtctttaggcggtgtggttggttctgggtctttgtctcctggattagttgaatcgtcttttggtggtgttgctggatccgggtctttgtcacctggattagttgaaccgtcttttggtggtgttgctggatctgggtctttgtctcctggaggagctgtagtgtcagtgttcttaagactttttagtgaaatagataaattagatttgaaattgtccctagcgtgggttggggtatcattactttgctgaatacctcctattacgtaaagtgtatcatcaacaatggcagatacgtgccccattcgataaggagcagaagaattagggatagttcttgatgtcttagtttctttatcatagagagtgactttgggaactccacctgttcttataatagaatcttcaaagttcaaagcatcataataacgcccaattccccccagccctatacttgtccattggtctattgatggatcgtattcaaacgtttcttgtccagataaaacatagagtttatttttaataactacagaatttccaactggagcgtctttttcaaattttttcttctttgtccattcttttgtttttaaatcgtaactatacgtgttactgtccaccaaatgctttaaggtacttcgataacccaaaatatagattttattatctatgacacctgcgtataaatcatatgaagctatcttaaattcaaatgggagatcttctacaccctcccatgtatctgttttgatattataaacttctacactatttgtaagcccttgttctgttctaccacccattacatatatatgatcacctacaataacactagcagcacccatacggcctgttttcatactagctttttctgaccacttatctagcttagtatcatatacataagtagtattagtaaattgcttacttggacctgttccaccaattacgtaaattttcccctcatacacttcacttacagcacctactcttgcatccggcaattctgctcgtttttcccatccaagcgtttctgctttttctgctttaatggattgtaaaggataacttaatgcagaaaataataaaatgaaaataaaaagccattttttcaagataaccacactccttcaatttgtttacataacaaatatcggatagttatttattttttccatgtttttgttacttatatatatatatttatttacttaccgtctccccaatgcgcctataaatttctaaaattagacttccgcacattagaattatttcatatttatattaattaattgcaggcattactcatatttttctatatctccatcaaaagaacccacgattcacagtcgcatttcaagttaataacatcttatacccccgctaataacgactgtgatatatacgattggttaaagcaagaaaaaagttccttaattgaaatttcactttataaaaatacaccaagtgcagtgtatttagcagacggtcaaaaattatgggaattggacaagtgataattaacaaatgaaaagcccctccaaattagaagggcttttcatttgtttctgttttaaatatatttagtcgctaccttcaaatataactctatttttcaatttatacatttttgattttgatccatttacgttcgtagtcattgaagaagctaatcaaaaatcagccacccatcttgatagcttcattgatacaaaaatagggaacggaaatacttaaaaacaagttcgcccccaacacgctcccaaaactctaatttgaagcaataatcgatcttatgttccaagaaacaaaaaagcctgaaatccttccatatcaaggatttcagacttttaatttagtacgtcccaggagagattcgaactcccgaccgacgccttagaagggcgttgctctatccagctgagctactgggacatgttgttatgtagtgtttttttggtgagtacctcaccgacaagatttattatattactattgttctttaaagtcaacggtttttcgaaagttttttcataaggggcaaatgctgcacccttatgaaataccttccaatgtgacagtgttttcgaggtcttgtatggcttgaccttcgtctgtgaaaaactgtacgttcgcttcgcttccatctagtgtcagtatagcatagctgcgctctttacgcactcttggtagatgcacgctgcctgggttaatgagcagttttcctcttagcagctcactgcctgggatgtgcgagtggccaaagcagataatgtctgcgcctagctcttctgcacggtagtagacttgaagcaaggattgtttgatgccatgcagatgtccgtgagtgagaaatagttttccgcctccatcaagtgggagcaggagctcttcttcaaaatcgcccataaagtcacaatttcctttgacgactttgtatccttcgagtgctgggtggttcgtgtcgagttctgaatctccgcagtgaatcatcatgtccacttcagctgcatgccgtttggcaatggtttgaagttcgtctgtgagtccatgactgtcactaatgatgagtatcttcatggcttcattcccccttattcatttgcgtctagcagtgatgaaagcttttgaagcgcgaccgctcgatggctgatcttgtttttctcctcaggtgataattcagccatcgtctggtctttgtctttgacgatgaaaatcgggtcatatccgaagccgttttcgccgattggttcctctgcgataaagccttctactgatccttctaccgtttttgtttctttacctggtatgctgacagctagggcacatctgaatctagctgtgcggtcttctttttcaatgccttgcatttcgctcagcactttttctacattctcagcatcatttttatgttcaccagcgtatctggctgaatagacgccaggttttccgccaagataatcaatcgacaaaccggaatcgtctgcaatgaccatttcacccgctttggcttgaatcgcctcggctttgataatggcattttcttcgaaggtatgtcctgtttcttcaatttcttcagtaaagccgatgtctgctagtgttttgaccgtgaatccttttggctcaagaatggctttgaattctttcgctttgcccgcattgtgcgttgcaatgatggctgttttcatcctgatcaaacccttctttttattcgatgacttctcctgtcactgctttttgcttttcaattaattctttgatgcccttttcggctaaatcaagcagtccgtttagctgctctcttgagaatgtcgcttcttcgcctgtcccttgaagttcaacaaagcgtccagcgcctgtcatgatgacattcatatctacttcagctgaagaatcttcttcataatttaaatctaacagaagaccctgctgagaatcaattccgacggatatcgccgctaaataatcagtgatcgggttttgtttgatgacaccttctgctcgaagcttttgaatcgcaagcgtcatggcaacaaaagcacctgtaatggatgctgtgcgtgtgccgccgtctgcttgaatgacatcacagtcaatccaaatcgtgcgttcgccaagcttttctaagtcaacgactgcacggagtgctcgtccaattaatcgctgaatttccattgtacgtcctgtcacttttcctttagatgattctctaatggttctttgagcagttgctcttggaagcatgctatattctgctgtaatccagccttttccttctcctcttaaaaaaggaggtacgcggtcttcgatggatgcgttacaaatcaccttcgtattgcccgctgagattaagacagagccttctggatgcgtaatgtagcctgcctctatttcaatttttcttaattcgtcatagtgtctttcatctaatctcatgatttacctccgttacaatatacattccgcgcgtatgccagcggggttctcctactaactttgacaacctcagctcgttctaatcgcttggaataaaaaagaggcagcgaatatgcatgcctctttttctccattatatcaatgtgtgacgttaaaaactacctgtattcacttgttctggtcgtgaaaccggctttgtcagctctgctcctttttcgttcacaagctcagccttgccgttcaccttgacagatacgcttttgacgtccggcagctcggttaatgtgagcacaatgctatcaagaactttttgtgaaatgacctttttcttttcatctgcactgccaaaaatggattcgttgaaatcaagtgtcacatgtccatcttttactttcgggatatcattcagctttacatcttgatcaaagtctgtgagcaaatggctttttttgcttgggccagagacgagctcatgaatggctgctgtaatttgatcatcctcatcttttggcgctcttttggtcactggaacatagtacgtctgttcatcagattcagctaagtaatacaccgtcactggctttgtcgatgtcatatcagcggcagcctcatgctgaatattaataccgtcttctctgcttaaatcctctgaaattggtgtgccattcacaggcatttcttttagttcatgtccattcatcttcaatttgactttggcgacagaatcaaactgcgttaacgtccaagtgaccgattgcaggatgcgctgttcatcttcttttttatagtttttgaattcatttgaaaaatccactacggccgttccgtctttaatgtcgactgagacgctcgtgtcggccggcaaaacagcccggaatccatttggtataaggttagaaatcggtcctccgtccacgaggtattcaagggtttgtttggcacttccttcatttttcggcagcggaatggattgagagacgacatacccgtttttatcaattaaatataattctctcatgactgtatctgccttcttctcttcttttccttctttggctgtttgtttatcttctttattatctttcacatatgtgacgttttgtggcgggtcaatctctgttttcgcttggtctgtttgaaacaatccgcatcctgacaaaagcatggctgacgcgatacacgtcacagctgctgtagatccttttttcagcatacttcaccctcctctagtagtttgtactactatgtatacgagctccctctgcggattagacccttttcataaaaaaataacccacctcaagaagaagtgggttattgctgatagacgtgttcgagtgatacggtttcgaccttccctggcaggtagccaaaccagtcacgagcgatgttttcaaaattttgctgctgccctgttgtataaaatgtatggacaggtgcttcttgagacgtgtttaacagccctttataggaaagaattgtactcgcttccctagcggtctcatcccctgatgaaatgatgctcacatcactgcccataaagcgctgaatcgactcttttaaaatcggatagtgcgtgcagccaagaataagtgtatcaattcctgtttctttcatcggttcaagggaatctttcaccacttcatctgctgtttgatctaaaaatgtaccgctttccacaaatgggacaagcagcggacaagccagactttgaaccgctagtcctgcttttagagatagcagagcttctttgtatgcctcgcttttaatcgtattggccgtaccaatgacaccaatctgctgattgtttgtcaccttgatggctgtgcgggcaccgggctgaatcacgccaatgaccggaatatcaagtgttgctttgatttcatctagtgcgatcgcagtcgctgtgttacacgcgatgacgagcattttaatatgatgatgtcttaataagtagtgtgccatttcccaagtatattgaagaacctcttcttctttccgagggccatacgggcaccgttttgtatcgcctacgtaaatgattttttcttttggcagttgtctcatgatttcctttgcaacggttaaaccgccgacgccggaatcaatgacgccgattggttgatccaacaaaatcgcctcattttcttttcatttgctgctgtagtttcgttaaggattgattgaaaacgatggcttcttcttctgagaaagcccctagaagttcactgacgtattcttggcgtttgacaatcacttcttgaatgatccgctcgccttcaggcaataaatgaatgcgaaccacgcggcggtcagaaggatcttttactcgttcgacaagttcacttttttccattcgatcaattaagtcggtggttgtactgcaagccaaatacatcttttgtgatagctcacctattgtcatatctccgaattcataaagccactgaagccctacaaattgaggaggtgtaatcgtatattgattcaggatttctctgcctttttgcttaataattgccgcaatatggcgcaatgatttctcaatctctgctacatggtcgaactcattcgtttccatttcattgatacctcactatagcatctcactttgattaaaacgtacattcctattttcctcgtttttcagagaaaatgcaagaagagactcatggaaaccatatagaaataaccggttcctccctggtgtggaaggaaaaccggctgactttagagctctagctcacccatacgcagaagctcgactacggcctgtgaacgacctttgactcctagcttttgcatggcattcgaaatatgatttcgaacagtcttttcgctaataaaaagctcgcttgcaatttcttttgttgttttatcttggacgagcaattcgaatacttctctttctcttttggttaatagcggcttggattgaaactctttctccttcaagtattgtaaccctccttgctaaggtgagagctctagtctctatagaatgggattctgtatagtcgagatatcatatgccggctgcccgaggtaggtgacgttaaaatcgagaattcccgcatatgagcgtccattttgcgcgcttttatccgcacaaaaaaaggacgagtctcctacccgagacatcgtccttttcatacacgtatttaaaagatagaaatagctcctgttaacaaagcaatcagcgttgtaaaaagggcggttaacacggtccatagcagggcgtacctttgcaaatcaccaatatctttgttcagcatactgacaagaaggagcgttgaagccacaagagggctcagcaagtggacaggctgtccgataatagaggcacgcgcaatttccactggatcaattccgtaagcagcacccgcttcagccaagatcggcagcaccccgaaataatacgcatcatttgaaagaacaaatgtaaatggcatactcgtcaaagcgacaatgagtggaaagaatgagctgtaggaatccggaatcatgtaaatgaccaaattagcaatggactccaccatttttgttcccgaaaaaatccctgtgaaaattccagctgcaaacacaagagtaatgaccgttaaggcatttcctgcgtgcgataaaattctctcgcgctgatcttcaacctttggatagttgatcatgagcgcgatgacaaatccaattaagaagagaactggaatcggtacgatatctaaaacaagtgtcgccatcaccgcaattgtcaaaaagaagtttacccaaatgaggtttggtctcttcatgtcttcgacgccatcttcaattgacgctgccaattcaggggagatcgaaatctcttctttgtactgaatctctgcgatcccaattcgtttccgctcttttttcccgagcacataggcagtaaaaaggatgaatagaccgccagctaccatcgttggaattaatggaataaaaaattcagctgcatccaagccaagtgcagcaattgcacgagtagcaggaccaccccatggggtcataccgctcataatgcctaatgataataatgaaatcgtccctaaaatcagcgggttcatcccaattcttaagaaaagtggcagcaaagctgatacagtaatcatgtacgttgtcgtcccatccccatctaatgcaacaagcatagacaaaatcgctaccccaaacgcaattttgacaggatcccctttcacaatacgtaaaatgagtttaatcagtggatcaaacagacctgcatccagcatgacaccaaagaataaaatggcaaataataataaagcagcagacggtgcaaccgttttgagtccatcaagcatcatatcccctaatccactgtaaaacccaccgatcaatgcaaaaatgatcggcacaacggttaatgccaccaccggatgcatacgttttgtcataataagaaatgtaaaagttacgaccattaagagtcctaaaatagctagcactttatatccctccatcctcttctttgcgcagtcagcaagcgcccctttgcacttgcgacctaaatgttagcgctttctatttcaaggatataatagctctttttataatgaaaatattgattttttcgtatattctataaatttcttttataatcaaccttgctggcttcttaaaaactctatgaatgctttcacaacagataaatgaagggagtctggctggtacataagccatgtatctcttaaaacaggctggccatctttatacgaaagaccttttacaaatagctcatcacttggtctgaggcaaatttccgggacaatggcgtagcctaaaccgtgcttgaccatctcttttgatgtatcctggcggtctgtctccatcgttacaagcggaggcatggtaaacgtttcctgccaccatctgttaatcaatcgttttaatgaactatctgtatgatagtcaatgagcggaagctttgggaggtcctttagctggatttctgattttgaaatgatacaaagccgctctttatcaagcaaaaaccgctctccattccaatcgtaatcccctcttaaaatccctaaatggacacttgatgtgcctaataaatccatgactttcgtgctccagcctgtattcaccatgaattgaacatgtggatactgcttagaaaattctcttaaaatttccggcagcttatactgagcaaagttgcttgagacccctaaccggattgtccctttgacctttttttgcatgttgagcatgccatcttttgtttgctgaagctgtttgagcatgtcatttgcatatgcagccaagtactcgccttctgacgtaaattcaatccctcgttttcttttaaagaaaagcttcatatcaaactcctcttcaagctgcttcaaccgatagcttaaggcaggctgagagacaaataatttttccgccgcttttgtgatgttcttttcttcatagagcacctttaaaaaccgccagtctttctcatccattgtgtgccctcctttttcaatggttataaaaaatttttattgattcctcttaaaataatgtatttaacttatttcttattatactttaccattttgattagataaacagttcattaaaaattgagggtgagagcaatgagaaaagttccaatcacaattatgcgaggcggtacaagcaaaggggtattcattcaagcaaacgatgcaccctatgaacacgatgagctcgaggcatttcttttagacattatgggcagtcctgaccggctgcaggtcgatgggatcggcggcggtaattctttaacaagtaaagtagccattattgataaagccacacgtccagatgtggatgtgaactatacgtttgcacaagtcagcatcaatgagagatatgtcgactttaaagggaactgcgggaatatctcatcagcggttggaccatatgccatcattaaaggacttgttcaagcggttgagcccattacgactgtacgtatcctcaataccaacaccaataaagtcattgtagcagaggttgaggttgaaaacggcgaagtgaaatttgagggagatgtagaaattccaggagtaaaagggacaggatctcccatctatctatcatttgaaaaacctgaaggcgctgtaacaggtaaaacctttccgacagggaaccgcatggatacgattcagacaaaattcggagagattccgatctcgatcgttgacatcgcaaatcccattgcctttgtccgagcgaaggatcttcatttaaaaggaaccgaattgcctgaggaattttcagacgcattactggatgatttagaagagattcgttccatcgctgctgaaatgtgtcactttgcgccaaaagacatggcaacattacagtcaccagccgttccgaagcttgcgattattagcgaacctgctgattatgtcgatacaaatggagtgatgagacgagcagccgatatggacatcatcgtacgcatgctatcaatgcaaagaccacaccaagcgcttgccattaccggctctgtctgtgtgtcagccagctgttttatggaacaaacactccctgcacagctttatgatggacaacatgatacgcttcgaatcgggcatcctgccggaattatgaaaacagacattgacgtgtctcaaaacagagtcaaagtcattcgaaccgcaagagaaattctagacggggttgtctttacgaaacaagattatattgtgcagcctcgtataaaaagagaagcctgaagcagacgagaacatcgtctgctttttttaatgttgaagcggggcatcaatatctcccgcagaatgagctttgatctgtcctttatcatcttttagctgaagatgaccaaagcggttaacaccgctgcaaatgccttcttcccatgtttgtttttcacgatctaacgaaatgcgaagcggcttgttgagtcgatataaccgtttgttatagagggcagtgagtgcttcaaacccttcattcttccagcgtgtatgatatttttcaaaagccgtggcaaggtccttcacaagctgatcggcttttacctctgtcagttcagataggcaaatggttttgtacgggacatgctccggctttgtttctacattgataccgacaccaatataaatggcgctgcggtctgcttctattaatgtgccggatacctttgcttcattaatgagaatatcattcggccatttgatcgccagctgatcgtccgctcttatgagtggtttcagcacatcatagattgctagtgctgtcagcggagcgatcgttgattgagtggagagttcttctggcggcatgactgtcatggttaccgccacattccctacaggcgtttcccatggcctgccgagtctgcctcttcctgctgtctgctggcgtgcatagacagcaaatgagggcttttctccttgctgcatgagccttttcgcttcattatttgtactatcaatggtgtcatattgaaaaatcttcatgtgttctcctcttgtttcttcttgatatgatgcttttattataacaaaatgaagtgtgcacgttgataattcagcatgctactcatttcgctgcgcctgaaatgtctttttttcttcttcagtaaatgggacagatgtgcctgtatctttactaatttgcaccatcgtgactgaccctgtaaagcatggttcctgctgctcattttctcctaagtaatgaagaatgagtgagcttgagcctaccttttccggcttgacatacacacgaagcctctctccaatctctacctgcttgatgtaatcacattgcagattagcgacgactgtcatggtctctctcacacgtttcatccgtttatcaacaatacctgttttttgaaaaaaggcaatgcgcgcctcttcaaaatacacaaaaggggtgacattgttcatatggccaaacatatccgtttctgaaaaacgaacagtggtttcgacataaaatcgaaaggatgctctccactcttcaaacggttcttcaatatatgacggcaatctcacttgatcatctccttatttggaaacaaaacgcctctcccgtattggaagaggcgtttgtttatatgttgcatccagcctcttaaacactcatcatgattggcaaagaggactgaatgtgatgttattctgcgtgatcgcttccgaagaagttacggaatgcttgtaaagttgtatctcggttaagtgcagcaattgacgttgtcagcgggattcctttcggacaagactgcacacagttttgggagttcccgcagttcgcaagaccaccgtcccccataatttcttctagacggtcagacttattcatcgcacctgtcggatgtgcgttaaataaacgaacttgcgaaagcggtgcaggtcccataaaggaagacttatcattcacgtttggacaagcttcaaggcagacaccacatgtcatacatttcgaaagttcataagcccattggcgttttttctcaggcattcttggtccaggaccaaggtcatacgtgccatcgatcggtacccatgctttcacttttttcaaggaattgaacatccggcttctatcaacctgcaagtctctcacaactgggaatgtcttcatcggctgaagacgaatcggctggtctaactgatcaataagggctgtacatgactggcgcggttttccattaatgaccatagaacaagctccgcacacctcttcaagacagttcatgtcccagttgatcgccgttgttttttccccttgtttattaaccgggttccgtctaatttccatgagtgcggaaatgacgttcatatttgggcggtaaggaatttcaaattcttcatcataaggctttccatctgctgtatcttgacgtgtgattatgaattgaatcgtgtttttttcactcatcttatttctccacctttttcttcgagtaatctcgtttacgaggtgcaattaacgatacatcgacgtcctcatagtggaatgcaggcttttgattttttcctttgaacgtagccatcgttgtttttaggaactcttcatcgtttctctctgggaagtccggtttgtagtgtgcgcctcggctttcattcctgttgtaagccccgatcgtaatgactcttgccagttgaagcatgttgtcaagctgacgtgtgaaggcagcgccttggttgctccatgaagctgtatcattgatgttgatctttttgtagcgctccattagttcttcgatcttctgatctgtttttaagagtttgtcattgtaacgaacgactgtgacgttatccgtcatccattctccaagctctttatgaagcacgtacgcattttctgttccgtccatgctcaggatgttgtcccatttctcctgctctttcttcacggcgctgtcaaatgttgcagaagataggtcttctgcagacttttcaagaccgctaatgtacttcacagcattcggtccagcgaccattccgccgtaaatggcagaaagcagtgagtttgctccaagtctgtttccaccgtgcatagagtaatcacattctccggcagcaaatagacctttgatatttgtcatttgatcataatcaacccataatccgcccattgagtaatgaacagcagggaaaattttcattggaagcttacgcgggtcatcacccatgaatttttcatagatttcaatgataccgccaagtttaatatcaagttcttttggatctttatgagaaagatcgagatataccatgttctctccgttgatgccaagcttttgctcgacacatacgtcgaaaatttcacgtgtagcgatatcacgcggtacaaggtttccgtatgctggatatttttcttctaggaagtaccacggcttcccgtctttatatgtccaaacacgtccgccttcaccacgagccgattcactcatgagacgaagcttgtcatctccagggatcgctgttgggtgaatttgaatgaattctccatttgcgtaatgagccccttgctgatagacgatggatgcagcagatccagtgttaatcatggagttcgttgattttccgaacacgattccaggaccgcctgttgccatgatcactgcatctgaacggaaggattcaatttccattgtcgtcaagttctgcgcgacaatgcctcggcatacttcctcgtcatctaacacagcgccaaggaattcccagccttcatatttcgtgacaagtcctgctacttcatagcggcgaacctgctcatcaagtgcatataatagctgctgacctgttgtagctccagcaaatgctgtacggtggtgctgtgttcccccgaagcggcggaagtccaataatccctctggtgttctgttaaacattacacccatccgatcaagtaaatggataatggacggcgctgcttcacacattgcctttactggcggctggttggctaagaagtctccgccatacaccgtgtcatcaaaatgttcataaggtgaatccccttcaccttttgtattcaccgctccgttgattccgccctgtgcacatacagaatgcgaacgttttacaggtacgattgaaaatagtttaacagctgttcccgcttctgctgctttaatagttgccatgagaccagctaagccgcctccgacaacgatgatgctagaattactcattgtagcccctctccctcttctactaatctatttcctcttaaacaaaagcgaaaattgctcttagccctacatatgaaagcgctataaatatacctaatgtcacatatgtggagattctttgtgagcgtggtgaaacagtaattccccagctgacagcaaatgaccacaagccattagcaaagtggaaaatagtagataaaacgccgacaatatagaaacctagcataaatggagagcttaaaatattcgccatcatgtcatagttcacttcagctccaagctgagcttgaattcgtgtttcccatacatgccaagtcacaaaaatcaatgtgatgatacctgaaatcctttgcagtctgaacaaccagtttcttaagtaactgaagcgagacgtgttgttttgtgccgtaaaggctatgtacaccccataaacagcatgatagatcagtggtaagaaaatcacgaacagctcaagtgcatatctgaatggaagctgttccataaagtgtgcagctttgttaaacgcctctggtccattcgtcgcaaagtggttcaccactaagtgctgaattaaaaatagaccgaccggaatgacgccaagcaaagaatgcaatctccgataaaaaaattctttgttccccgacattactttaccccctagtaaaaagtgcaattgctgaaaattgtcttacccccgcttctttcaattgtaagcactttattcaaatttattgacaatttcattttactcctatgtcaaaaaagcgtcaagaaaccgcgtacataaattaaaattttccgaaatttaaaagttttaaatcaaaattcgttttactacaataagaatttcttagacttcagggaaaactctgtcatcatatgctcacataagctataataaattgttgaaagaggggagccgtacaatgaataaattcgaatctaacttagaacagctaaaagaaattgaagtcaatggatttgcctacgagctgatacgcgaagttctgctgcctgatattcttggtcaggatcattcatctatgatgtattttgcgggtaagctgcttgctcgtaaatttcctcaagagtcatgggagaagatccccgaatttttccatgatgccggatggggaactctcacgatggtccattcgaaaaaacaggaaattgagtttgagctcgaaggtccacttgtatcaaatcgactcacctatcaaaaggagccatgctttcagatggaagcaggttttattgctgaacaaatccagcttctcaacgagtacgtggctgaatcttatgaacaagtgaaaaagcgtgctgataaagtcattttaaccgttaaatgggatttaagagacccaagctaactctctttatgaaaggcgcagacttcaggtcacgcctttttttgtttgccttcttctatcatatcatacttagtgaatgggtttgcggcggtttcgaatataaaaaagaggtgcactctttcatgagatacacctccggcctttttaagaatgcgcagctacctttgataaatcaaacgcatcatgcaatgcttcaactgctttgaccatatcgtctcggccaaccactgttgagactttaatttcagacgtactgaccattttcacttggatgtctttttctgctaacacagcaaacatttcagcggctacgcctggatttgaaaccataccagatccaacgatggatactttggctaatttgctttctgtctcgatctgttcgtagccgagtgctcctttatattcttctaacacttcaactgttttagacaaatcatccgttttcacagagaaagagatcgacgtctgattggtgcttgtgacagactgaatgatgatatcgacattgatattttgcttcgcaagtgtcgtaaagatggtcgacaatgtggtaagaccgcttgaaagaccgcacaccgtcacgcgtgtaatctgatcctcaaatgcaatgcctctgacgactaaattttgttccatggatgattcctcctcaattaacgtacccgattcattttcaatactagaacggacttctagcgggacttgataatttttcgcaaattcgacagctctcggatgcaagacaccagctcctaaattagccagctctagcatctcatcatatgaaatacctgcaagtttccgcgcggccggtacataacgcggatctgtggtaaacacacctggtacatctgtgtaaatatcacatttatccgcttttagtgcagcagcaagtgccacagctgttgtatctgatccaccgcgtccaagcgttgtgatatgcaaatcatctgcaattccttggaagccagccacaaccaccactttcccagcacttaattcctcttttattcttgattcatcaatatcgacgattcttgcgttaccatgtacttgctctgttttcataccagcctgccagcctgtaaaggaaatggcatcatagccttttgcttgcagcgccatcgttaataaggaaatggtcacttgctctccagttgcgagcagcatatccatttctcttttgctcggatgatctgtgagttctttcgctaggtctactagaacatccgttgatttacccattgccgacacaaccacaaccacatcatgtccggcctcgcgttcagcgatgaccctttctgcagcattgcgaattttttctgtcgatccaacagacgttccgccaaatttttgtacaattagtcccatgtctaccaccctttttcaaaagatcacgtgtgagagaagaggcaagaagcggctttggagactgcctgctcactgcaaataaaaaaagcaatgagagaacagatctcccattgctttataatcatcatcaaacgatgcaaacaatgagatagccctccaagaaataaattcttgacagccctacatttcttcaatgtacagccagcgaataaaatgagtggattttattcacttcggcgacgctcccctttcagccctcttcctagatcccatcgatctctgaaggcttactcttgaagttcgcacctctatcttcaacaaacaacacgttcatttattaaatttagtcacaatcttaacagacttttggaaaaagtacaatctatttttttaaagcttccattaaaagctcggccgtttgtttcgggatgccagcctcctgaaattcttggatagaggcttctttcatctttttgacagagccaaaatgtttaagaagctgttttttacgcttttctccgatacctggcacatcgtctaaaatagattgaaatgcattttttcctcgcagctgccggtgaaagctaatcgcgaaccggtgcacttcatcttgaatgcgctgcaataaatagaaggcctggctattccgctccagtgcaacaatttccagtgtatcgcccatcatcagattcgacgtcctgtgcttttcatcttttactagacctgctactggaacagacagattcaattcattttcaagcacatctatcgctgcattgatctgtccctttcctccgtcaattaaaatcaaatctggcagcggaagctcatcctttaacacgcgggtatatcgccttctaatgacttcacgcatcgatgcataatcatctggacctgtgacggttttaattttgtattttcggtattcctttttatacggcttcccgtcctgaaagacgaccatagcagaaaccgggtctgcaccttgaatattcgagttatcaaatgcctcaatccggtaaggcatatatatattcagcgcatctccaagctgcttcactgcaccaatggaccgctcttcatcgcgctcaatgagcgaaaatttttcttttaaggcgattttagcattttgatgagcaagtaagagcaaatcctttttctttccttttttcggctgatgaacgttcgtctcaagcaattgttcaatcatctcttgatctacgctatctggcaccagaatttccttcggcagaaagtgattgttcttttcataaaattgccccataaacgtgagaaactcttcctcagggtcttgatacataggaaacaggctgacatcgcgttcaatcaattttccttgcctgatgaagaagacttggacacacatccagcccttgtcataggcatatgcaaaaacatctcgatctgataaatcgctcatcgtcattttctgcttttccatcgtagagtcgatatatgcgatttgatctctcaattcttttgcgcgttcgaactctaattgttcggcggcttcctgcatcttttcggtaagttcctttttgatttgctgatgtcctccgtttagaaaccttatgatttcgtccacgagctgcttattcgtttcttcagaaatgtcatacacacatggcgcgagacattgtccaagatgataatataaacagacgcgatcagggagggtcgcacattttctgagaggatataaacggtcgagcagctttttcgtttcacgtgctgcctgtacattcgggtatggtccaaaatatttccctttgtcctttttcacatgacgggtgacgatcaatttaggatgtcgttcattcgtaattttaataaaaggatacgttttgtcatccttgagcatgacattgtattttgggtcgtattttttgattaaatttagctctaaaatgagtgcctcgatattagaagaggtgacaatgtattcaaagtcctcaatttcactgacaagacgctgcgttttggcgtcatgagatccagtgaaataagagcgtactctattttttaagacctttgccttccccacataaatgactgtattttgtcgatctttcattaaatagcagcctggttgatctggcaagaccgatagcttttctttgatcagtttgttcatattttcatccgtccttgttttcctctttcactccttctagtgtatcacgaacatttgttttataccatattgaaagaaaagcggctctcgtctttacgagaaccgcttcagtgagtatgccgctagggcatagacaggtttatagatgtttgttaacaagctcagcaagtgcttcttttggtttgaaaccaacagaagtttctaccacttcaccgtcttttaagacaagaagtgttgggatactcatcacgccgtatttaccagcagtttcttggttatcatctacatcaatttttacaattttcattttatcgcccatttcttgatcaagttcttcaagaactggagcaatcattttacaaggtccgcaccatggtgcccaaaagtccgcaagaacaacaccttctgcagtttcttgtgaaaatgttgcgtcagtagcttttacgattgccattattcattcctccaatgtaaattatgctttttagtatagcatctaccaatgtgacttgcgaatgaaatgcttacgaatcattttttatgaaatgaattaaaaaacaaaccgtataatcgcaccaatgacaacaattgcaccgataatcatgagaatcgttctaagcatataaataactccctttccgcttcgtttacaatgtatgatgccccaacatcctcctcatcaaacatctaaatatgcgatcaagccagatcgatcgtgatcatcaccacagacattggcggcagatctatggtcaactcaccgggttttacagcaaattgctgaaagtctgctggctggacagcatgaggatcatcaaatgtgttgtgcgcattcatgcggtccgctgtcagcacacggcccgtaactttcgtttttgcatccaaaccttcaatggcaagggatacttcgttttgttcatgcggattcaggtgacagaagctaatatgcatcttatcggacgaacgcgaagctgacacactaacctgaggtattttttcaccgcttcgttcataaggtgttgacacgaattccacttcaagtgcttcctcctcttgatgcacttgaaacatgtgaaacacatgataagtaggcgtcagaagcatcttttcgtctttcgttaacaccattgcttgcagcacattgaccgtctgggcaatattcgccatatgaatccgctggcaatgacgatgaaagatatgaaaatgaagggcacaaacaagtgcgtctcttagtgtgttttgctgatacaaaaatcctggattcgtacctggttctgggtcataccatgttccccattcatcaatgatcatcccgattcgcttgtctggatcataacgatccataatctctccatgatccacgacaagccgttccatctcataggcttttttcaatgtgataaaccattcatcttcatcaaattcagtcgctgaccctttcttctcccacgtaccaggtacggtgtagtaatgcaaactgagtccatccatccaaggtgcggcccgttccattaatacttttgtccaattcacatcatttgaattggcgccgcatgcaattttgtatatggtctgacctgcaaactctcttacatacgtttgataacgtttatatagatctgcatagtattcaggcgtcatattcccgccgcagccccagctttcgttgcctacaccaacataggtcaggtcccaaggttcttgttttccattttgaatgcgccaatcagacataggtgttccctttggaaatgtgatgtactcgacccagtctgctaattcttgaacagtcccacttcccacatttccgcaaatataaggctcacattcaagcagctcacacaatttcataaactcatgcgtaccaaatgcattggattcaacggtaccaccccaatgagtgttcaccatcggctttcgttcgctcatatctcccacaccatttgcccaatgatactcgtctgcgaagcagccgcccggccacctaagcaccggaatatgtagtgcttgaagggcttttagcacatcggtacgaatcccctcaatatgatcaatctcagaatcttttccgacccaaatcccgtcataaatccctcttcctaaatgctcttgaaaatgtccatagatgtgtttagaaatacgtccgatcacgtcattgacttttactgtccccttcacttgtcaaccgctcctttgtgtattgattacatacaaaaaaacccagaatacctaggcattctgagtgtatgagcgttacgagtggatattcatcttttttaactcttcattcaaaagcggtaccacttcgaacaaatcaccgacgattccgtaatcggcaattttgaagatctcggcttctgggtctttgttaatcgccacaatgactttactgttagacattccggctaaatgctgaatcgcccctgatatcccgcatgcaatatagagatcaggtgtgacgaccttgcctgtttgcccaatttgcagggcataatcacagtagtctgcgtcacaggcgccacgcgaggcaccgactgctgcgcccagcgtctcagcgagttcattcagcggttcaaacccttccttactcttgaccccgcgtcccccggcaacaatgacctttgcttcagataaatctacaccttctgacgtttttttaatgacttccttcacgatcgttcgcaggttctgaatatcgacagaaaccggtgtaatgtctccgcttcgtgaggcatcccgctcaagaggtgccacgttgtttgggcgtatggttgccaaaagcagacgatctgttgaaatcactttttcaaaggcttttccagagtaaatcggtcttgtgaaaacaagatgttctccggtaacgcttacatcaatcgcatctgaaattagaccagtttgcaagcgtgcagctattttcggcgacaagtcttttccgatagacgtatgtccaaagaggaccgcatctgggtcaacctgatctaatatggcttgaagtgcctgcgtaaaaccatctgacgtataatatgaaaggtgcggatgctccacaatcatgacatgatccgctccatagtaaagcagttcattcgcttggtctttgacgtcatcccctattaacacgccaatgacttcaccgccatctgccacttgatgagcggcagcaatggcttcaaatgtcacatttcttaatttaccgtcacgactttctccaagtacaacaacttttttactcatctttcaagttcccccttgttctcgtgatatcgtaaagtggatgtttagatgacctttgcttcatttcttagtaaatctgtcagttctttgacttgatcctgaagctcaccgctcagcaccttgccaccctcttttttctccggtaagaaacgttcaattgttttgattttatatgggacatcatcttcatcgagatctaaatcatcaagttccaactcttctaaaggctttttctttgccttcataatgccaggtaatgatggatagcgaggctcattgagaccttgctgcgcagtgacgacaagcggaagctcagcagaaatgacttccacatcaccttctgcatctcgttcaatcgaagcagagccgccgtcaatttgaatacttgtgatggttgtgacatatgaaaacccaagtaattcagcaagacgcggggcaacctgtccagagcccccgtcaattgccacattccctgctaagatcaaggacgcctctttgtcttttaaataatggtaaagaatcgtagaagctgaatattgatcccactcttctaagtcgtcttccacatttaataaaacggcttgatcgcagcccatagcaagcgctgttctcagctgcttttccgcatcctcactgccaactgtcacaacggtcacttctcccccgtgctcgtcgcgaagctggatcgcttcttctatggcgtactcgtcataaggattaataatgaactctgccccatcttcttgaattgcaccagactgaatggaaatcttctcttccgtgtcaaacgtacgcttcatcaaaacaaatatattcattcatttctcccccttgtgtcgtttgaatcccttattcccctttaaaattcggtttgcgtttttcaataaaggcttggatgccttctttggcgtcattcgattggaaaatttcaccgaactttttggcttctagcttcataccgccatcatatgaatacaattttgtcgcattcaataaatccagcacatactcgagtgattttggacttttcgttgcaaattttgatgcaagtgttttggctgcttcgagcgcctcttcctctgtttctgccagctttgacacaagtccacaggcgaatgcttcttcacctgtaatcggttcagctgtacccatcatttctagcgctttagcagaaccaacatagcgcggcaggcgctgcgtaccgccgaaccctggaatgatacctaggtttagttcaggcagtccaagcttcgcatcttttgttgcgattcggatatcacaagacatagcaagctcaagacccccgcctaatgcagctccgtgaattgaagcaatgaccggttttggacattgttcaatccgctcaaagacctgctgccctctgtctgcaagacttgaataatcagactcttcctgtaacgtcgtaaattccttaatatcagcacctgctgagaaaaatcttccttctccgtggatcacaatggctcttacttcttcattttgttcgagctgttcaaacatgtcattaagctcggtgagcagctgagaagataaggcgtttgctggtggatgctgaatcgtgataagtgctgtctgcctttcgtgatgtaagctgagtatcttttccatgtcaatcatcctttttcaaaatgtctttaagattgatgtattccgtttaagagtagatcacgtacgttttctgcgagtgcaggaagatcatatttttgatcattcatgacccatgttgtagcggtttcatcaatcgtcccaaataccatttgtctcgctaagcggacatctagattttgtctaaattctcctgttttctttccttctgctaaaatggattcgagcatatttaaataccctttcagcacctcattgattttttgccgcagctcaaggtttgactgcctgagttcaagctgtgtcacaagagccaaatgatgattttgcgcaagcatacgaaaatgctcctcaatgagtagtagaagcttttctttcgccgacggtttcttttgaatatctgtttccatccgttcgatgaattgtcccattttttctttgaacaatgaaatcaaaatatcctctttatttttgaaataaagataaatggttccgtctgctacccctgcttgtttcgcaatctttgacacttgtgattggtgatagccattctctgcaatcaccacaactgctgcatcaataatttgcatgtacttcggtcttttctgcttcaatgtgcttcgtccctttctggattgaatgagtattcattcataactttatgttaaaaagaaacgggcgatttgtcaagtaatcttcttctttcttttccacctttagcataacagaccagacggtcaacattcaaatcatccggccggtagaccggatgatgcagccgttatgttttcggttgatcggcaggcgtttcagatgatgaagcgtgctttcttttctcttcttcaattaatactctgcgcaaaatcttcccgacggctgttttaggcagtgactctttaaattcatacacgcgcggtactttaaatgaggcaattctcgtcctgacaaagcgatcaagttcgtcctctgttaagtaggcattctttttcggtacaataaatgctttcactgtttctcctctgtacggatctggaatacctgcgacgacgacttcttgtacaagctcatgctcataaagagcttcttcgacttctcttgggtaaatattatagccgctcgcaatgatgacatcttttttccggtcgacgatatagaaaaaaccgtcctcatccatataccctatatctccggtgaaaaaccagccatctcgtaatacagcctctgtctcctctggctgattccagtatcctttcatgatctgagggcctttaacaataatttctccatgctcatatggttctttcaggcctccggtttcctcgcaataaataccggcatctgtattaggccaaggacagccaatgctgcctgttttgttcgctccccataaaaagttagaatgagtcacaggtgaggtttctgaaagtccatacccctccactaagcgtcctccggttaatttttcaaagctttgtttgacttcaagaggaagtgccgctgagccgcttagacatgcagtgatggacgacaggtcatacttttcaatgttcggatgatgcagcaaggcgatatacatggttggtgcgcctggaaatagcgtcggcttctgtttttcaatggttttgagggtatcagcgacatcaaagcgtggaagaagaatcatttgatgtccttctttgacagcaagatttaagacggtcgtcattccgtagacatgaaaaaacggaatgatgccgaggatgcgttctttccccctgtttgttttatacatccaggaagcgcacatttcagtattcgctaaaatattttcatgtgtgagcatgaccccttttggtaaaccggtcgttccgcctgtatattgcaaaacagcgatatcctctttcggatcaaaggcaagtgcgggtatctgctgttcaccttccgattctttcataatctgcacgaagtgatgaatggtgtcatttttctcgacttggatgaccattttattttttcttctttgcacaataggaaacagtatgtttttcgggaatggtaaataatcttgtagtttggtaacgattaagtgctcaatacttgtcagcgctttcattttataagcctttggatacaacagatcaagcgtgatcagcactttggcgccgctgtcttccatttggtattccagttctttctccgtataaagcgggtttgtttgaacaacgatgccgcctgctattaaaacagcataataagaaatgaccgattgaggacagttcggcagcatgatcgctactctgtcgccttttttcacgccaattttcatcagatgactggctagtttcaatacgtcttcttgcagctgttcataggtgatgttctttcctagaaaatgaatggctgtatgctcaggtgcagcctctacggagctgaataagtaagattgtaatgtttcgtttgggatggtgagttcgtggggaatttgattcgggtaatgcagaagccaacgtttatctgactgcataaaaaccctccttcctgaactttcgtactattatattatagcaaacttttccttagggcagtttgcttttttctaatagagcttggttcaattgcacatgtttactttttcgccggtgtttcgatagaagctctttttccttcatgatgccactgttcatataaaccgccgatggcacgaaatgattcgttcactctatccacgatctgttgatggatactcggatcattcggtaaatgcgtctggatgttgtcgacttgatgctttttcatcatgtcgatgtaaaccgtgagaaaaatggtatcttctaaaatccagtaaatgacttcatctgccacttttgttcttttatgcagcatttgaattcctcgttcatattgaatgaggatataaccactcgaatcgatttgaatatagggactcaaatcatcaaaaaatcctgacgtttgaaatggacgtgccatatacggttcgtatatgtctcttggaagggatgtcatttgaagacaagtatcaatgcgcttgatcagttcgtcttgttgcagaatgtgcttcatgtcattcgccgcctttgatgagataaaagctgccaagggattccctgacagctttctaacgttgtttttttcatttcacaggaacagataaacggcaccaatgactgcaaaagtgcaggcaactacgattaatacttttgctagcttttccatgtcgtctccttaaatgccggctgcgactacgtaagacagcccaactgaaatgatgagtgaaataaacccgaccgctctattatcattttcaatctctttgtctactttaaaacgcggtgttaaaaattcaaaaatgaaatagctgacaagcagcatcacaaagccgtataccccccatccaaccatttgaagaagggaattgtgctgtgcgattgaatgctgaaacacattcgcaatcccaaagatcttcccgcctgttgccatggcaacagctaagttcccccgctggatctcttcccagttcttataagaagtgacgagttcaaaaatggttagaaataagacgagacataggacggccacactataataggcggcaatttccacaagttcattttcccaaaaggctttcatgcgttttctcctttttactttaattcgacgatggtgacgcctgatcctccctcaccttgttcgccaaaacgagcatttttcacacttcggtgctgtttcaataattcctgaaccccttttctaagggcgccagttcctttaccgtgaataatagacacgcgcggataaccagctaatacagcatcatctaaatatttttcgactctgcttaaggcattttcataacgctcgcctcttaaatcaagttcaagcgagacatgataatcttttcctttgactgccgtaatggctttttcttgcttaaattcaggtgctgatttaataaattccatgtctttttcttttaccttcatttttagaatgcccatttggacactccattctttgtcgcctgtttgttcaagcagtgttcctttttgtccgaaggtgagcactttgacttcgtcgcctgacttcagctgtcttactgcttttttcgctggctctggcttctttttcctgtcaaactcaggaacagcttcttcaagacgctttcgcgcatcgatgagttcatgctctttgaatgagcggtgttcactttttatcgaacggagctcttgaataatatcttctgcttcttttgatgcttgttcaattttctctttcgctttctgttcagcttcttcaagcagtttgtctttttgctcattccattcaagaatttgtctttgcaattctttatgaagcttttctgcttcttttctatagacttctgtctcatgcagttcttcttctgcttgtttcttgctatcttctaatgaagcaatcatttggtctacttcattatgctctgcatgcatatccgcttttgcccggtctatgaggtgatctggcaaaccaagacgctttgaaatttcaaatgcgttacttcgaccaggcacaccgatgagcaggcggtacgttggtgataaggtttcgatatcaaactccacgcttgcattcgtgacgccttcccggttatacccatatgccttcagctcggggtaatgagtcgttgcaatgacacgtgcatttgtttgatgcacttcatctaatatgctcatcgcaagtgccgcaccttcagctgggtctgttcctgcccctaattcatcaaataaaacgagagagttagaagtcaaatgctttaagatatcgacaatattgaccatatgagatgagaacgtactcaagctttgttcgatggattgttcgtctccaatatcagcaaaaacttggtcgaacacagccacttcagagccttcttcaactggaatatggaggcccgcctgtgtcatcagcgtcaatagacccagcgtttttaaggtaacggtctttccccctgtatttggtccagtgatcacgattgttgaaaaatctttaccgagctcaatatcatttgcgacaacttgatcccgaggcaatagaggatgtcttgctcgttttaaatagatttctccttgatcattcacagcaggttttgtggctttttctgcctttgcatatttagctttagcaaaaataaaatctagcgtttgcagctcctttacattgtgaagcagttccccaatgtgctctgacacactctctgtcagcatttgcaggatcttttcaacctcttgcttctcttttaaacgggtttgctgcaaggtgttatttacatccacgaccacttgcggctcaataaaaagggttgcccctgatgaagactggtcatgaacaatgccgccgtaattcgagcggtactcttgtttcactggaataacaaaccggtcattacgaatggtgacaattgtgtctgacagcattttcgaagccgattgtgaacgaatcatcgcttctaatttatcacggacctttgattctagtgagcgtaattgaatgcgcaatgaacgaagtgccggggttgcatgatcaagtacttctccattatcaccaatacagctttcgatttcttttctgatttcaggcagtaatatgagcgtctcagcatatgtatgaagacgcggtatgtctactccatcatcatacatggacgtgagaaagtgcttcatatttttcaccgcatataatagtcctgcgatttccatcagctcagaagggcttaatgtacttccgatttctgcccgtttcactgcgcgtctaatatctgttaacccgccaaatggcgctgatccctttaatcggatcacatcttgcgcttctgctacctcttccagcaaatgctgaatggtttctatatccgtcagaggtgttaaatcctgcgctctttcttttcctaatgtggatgcggtataggacatcactttttcttttactttatgaaattctaatgatgctaacactttttgttgcagcatggtccagcctcctaacgactacctgtcacgcgttaaaaactttttgatctcgtttagagtaaaagtattcacgacatttgcttttggtgtccagccctttcttgcagctgttacaccgacttccatatgttccagcatggcgatgttgtgcgcatctgtattgatcatgatgttcacacccgcttcatttgctttgattaaatgctctgttttcaaatcaagtcttgacggattgctgttgagttcaagtgcagtgcctgttttcttcgcaagttctatgagctgatctatatttaaggcatagccatcccgtctgccgatcaaacggcctgttggatgtgcaattaaatcgacatgctgattacgcaaggcattttcaaggcgttccataatgacttcttccggctgagagaagctagaatgaatagacgcaatgacaaaatccatgtcttttaaaaagtcatcatcataatctaacgatccatccggcaggatatccatttcgacccctttgaaaatgtgaaaatgctcgaattcctgattaagcttatcaatttcttttgcttgcagacgcaaacgttcttttgttaagccgtttgctacttttaaatattgcgagtggtctgtaatcgccatgtattcatagccttttgcgatacatgcttccgccatttcacgaatagagaaggctccgtcactccatgtcgagtgcatatgaaggtcgcctttgatatctttcagttctacaaactgcatactttctttatacgtatcaatctctgctccggtttcacgaatttctggaggaatgagcggaagttgaaaatgtgcataaaaagcgctttcgtcttcaaacgtttttacatctccagtttcaatcgtttccacaccatattcgctaatgcgctctccgcgttcctttgcaagctgacgcattcgaatattgtgatcttttgagccagtgaaatggtgcagcgtagttgcgaattggtcttctgtcacaagccggaagtcgacactgatctcaaaatcaagggcaagcacaacagataccttcgtatcaccgcttgcgatcacatctttcacatcatcaagtgcaacgagctgctctctgacttgctcaggattgtctgttgcaatgatataatctaaatctttgacggtttcgcgagcacgtcttaagctgccagctcttgaaaaacggatgatacctttcatctcttcaagcgcatgatcaatccgctctgccacatctaatgcaaatccaattggcagtcgttccggctgctttcctgcttcctcaagagctgcgagaatcttttcttctgtttttttgccgaagccagcaagcgcttgtaccttttccgtttcgcatgcttcttttagagactgtgcatcatggaccccaagctcttggtaaagcttagcgatcttcttcccgccgagtcctggcaatttcaaaagcgggacaagtccttcaggcacttctttttttaattgttcgagtgtttctgattgtcctttttcgatatactcagtgatcacagcaaaggttccttttccaatgccgggtaatgctaatagatcgtctatttgagaaaggctgcggtcatcttgttccagtgccgctgctgctttacgaaaggcagaaattttaaaaggattatctccttttagctccatatatactgcaattgtttcaagaagtttgataatatcttttttattcatctctcatcctccagccgctttggcatcttcctttataaatatacaaacttttccttcatcctacaactttctgtcatggaatgagaaaaaacttctccaagaaaggagaagtttttaaactccatacgtcgtccataagtctttgacaagaccggacagataaggggtgttgcttacgatcgcatctgctaatatggatttactcaacattgtttgcagtgcatcgactggaagtaatgcagcgacaaacaaaagaataaaaacaaatagataggtttcaagaaatcctaaaacaccgccaagcagtttattgacctgcttaatcacaggtatacttgcaatggttgtgagcaatccgccaatgatggcgagcaggattttggtcaagataaacagaatgataaacgcaatggtattataataagctgtttctagattcccactaaagaaagcgagctgcgcttgaccgccgctaaaattaggtgctggaatccacgtaagctgtggtgcaagtgactgataaaacatggaagccactaagatagaaacaacaaagctgatcaatttaataaattgaagaataaacccgcgttttagaccgacaagcgttcccataagaagcaaaaacaaaatgatgatatcgatcacggtaatttcattccttttctctaagctgattctctagtttttcgtattgctcttttaatttcaagtagtcgtggacgacattgactgctgtcagtacagctaatttgtttatatcaaggtatgggtttttttcatttatttctctcattttatcatcaacaattgaagcaacgtgtcgcatatgcatcttcgtttcttgaccgatgatcgtaaaggactgtccgtaaatctcaactgttgtttttgttgttttcgttttaccgccgtcagacaacgtttctcctccattccacgagaatcctagtctctatcataacatgtttagacattgaatggaaagacgagcccttccctgttatggtacactttagaaatcaatgatatcaaggtaaaaaggagttatccactgtgccacaatccgtcttaaaagcaacatcagaagaccttaaaaagatgaagagcgcgtatgcgcaccacttaactgatacgttaccaccaggcgccctttttcaagcaaaggttcctggctgtacgattacagcctatcgatctggaaaagtgctgtttcaaggtcaaaaggcagaagctgaagccagtcaattcagccatttacaaactgctgatccgaaaagtccaaaagcacctgctgtcacaaaatatagtccgccgtcagggattgcttctatgtccgtcatcggttcagatgaagtaggaacaggtgattattttggaccgataacggtctgtgccgcctatgttgattcaagcaagcttgctctcatgaaagagcttggcgtaaaagactcaaaaggcctaaaagacccgcaaattatcaacattgccaaagatctcatcaaaaccattccgttcagccttcttgtactccgaaatgaaaagtataatgcgctgcaggaaaagggcatgagccaaggaaaaatgaaggcgctccttcacaaccaagtcatcacctctgtgctggagaaattagatgggaaacagcctgaagctattttaattgaccaatttgcagaaccgggtatttatttcaagcatcttgctggaaaaaaaattattcgggaacggacgtactttagcacaaaagcagaaggcattcatttgtcagttgctgcggcttccattattgcaaggtacgcttttttaattgaaatggataagttatctaaagcagcagggtttgacattccaaaaggagccggccctcatgtagacaaggcggctgcaaagctcatcaagctgcacggcgaagaggctttacgtcaatttacaaaactgcattttgccaacacacaaaaagcaaaaaaatggttataaaaaagagctaggcccatatggccttagctcttttttctttaaccgcgcaagacggcttgatacgtatcttctaatgctttcaatactttcgtatgaactgcggtgacttcttcctctgtcaaagtttgttccggatttaaatattggagagagaatgcaacagatttcttgccttcttccatgtgttcaccttcatacacgtcaaagacggatagatcagtcagtaaatccccgcctgcctcatagatgacacgctccagctgtccgcttgagatatgctgatctacaacaagtgcaatatctcttgtcacagcagggaatctcggaatcgctgtatatttcatatccttcgattccgacgtcatcacatctgttaaatcaaactcgaagacatatgtttcttttaaatctaattccttttcaacgactggatgaagtgcagcaacaaacccaatgacttttccatttaaatgaacatctgctgtccgacctgggtgaagaccttcacgctctgcttgaacatatgtgatttggtctgatacaccaagcttttcaaatagaccttctgcaattcctttcgctacataaaaatcgacagcttttttctcgccctgccaaagatttttatgccataaacctgtcagcgcaccagcgacatgttctttttccaccgtttttgccccttcagcttctgctaagaacacagaacccgtttcataaaaaccaaaggaatcagcttgtcttgccaagttatatgcaactgaatcaagtaagtttggcagaagactttgtctgagcacacttcgttcctcactcattggcagggaaagtcttgttttataagctggattcaatgcaaaggcagtagacttatgctgatttgtcaatgaatacgtgatcgcttgagaaagacctgcgccttctaagaaacgtctcacctttctgcgtttcacttgatatggcgtgagaccgccaactgtaccagctgtcgcaggtagtgtagatggaatattatcgtagccgtataatctcgcaacttcttcaatgagatcttcttcaatcgtgatatccattctgcgagaaggaaccgttacgacaagaacgtcatttgattcgcctactgtaaagcccagtttgttgaaaatttgaatcatatcttcttttgaaatgctcatgccaagcaccttgttcacacgctcagtagatacgtggatgacattcatatttatttcaaggtggttttcctccacagtcccgcttagcacttcaccaccagcatagatgctgatcaattgcgccgctctttcggctgcagatttcgtacgctgcggatcaagtcctttttcaaatcgtgtgcttgattcactgcgaagccctaagtctctagatgcttgacggactgtttgaccgttgaaatatgccgcttctaaaagaattgttgtcgtttcatcacgcacctctgattcaagaccgcccatgacgcctgcgacagcgtgcgctttcgttccgttagtgatcacaagatgctttgatgaaagtgtacgctcttgctcatcaagtgtttgaatgctttcgctatcagtcgctttacgtacgaccacttgctttgaaccaaagcggtcataatcaaaggcatgaagcggttgaccgtattcaagcagtacaaagttcgtaatatcgacgacgttgttaattgggcgaatgcctgcattcatcaatcttgtttgaatccaaagcggtgctggtccaatctttacatttttaatgaccttcgctgcataaagtggattcgcttcttgatcttcaattttcaccgaaatatagtctgctgctttttctgaagacttgtcatgtgctgtatcaggaagtttggtgtctttccctaagatggctgcaacctcataggcgacacctagcatattcagagcatccgcacggtttggtgttaagccaagctcaagtactgcatcgtctaattgaagtgcctgaagggcatcatccccgggtttgacgtcatttgggaaaacaaaaataccttctgcatattcctttggtacgagtttgctttcgacacctaattcttgcagagaacaaatcatgccatgagactcttcgccgcgcagctttgcttttttaattttaaagttcccaggaaggactgcgccaaccgttgcgacagccacatattgacctttatccacattcggagccccgcaaataatttgaaccggttcgtcttctccgatatccacgagacatttatttaacttgtcggcattcgggtgctgttctcgctccacgacgtgtccaacgacaactcctttaatgccttcgcctttatattcaacggcttccacttcaattccgcttcttgtgattttctctgctaattcatccggctgaatgccttctaaatcgacatagtcttctaaccatttatatgaaacaaacatgttgatttcctcctcttagtcctgcttgaattgctttgtgaatctaatatcatttgtgtagaaatggcgaatatcatcaatgccgtatttgagcattgcaatccgttcaacacccattccaaaagcaaagccttggtaagtttctggatcaaatccgctcattttcaaaacatttggatgaaccatcccagctcctaaaatttcaatccagcctgttcctttacatacagaacagccttttcctccgcatttaaagcaggacacatccacttcaacagatggttctgtgaatgggaaaaagcttggacgcagtctaatttcacgatcttcaccaaacatttttcttgcgactgtctcaagcgtaccttttagatcactcatgctaatattgtgatcgacaacaagcccttcaatctgcatgaattgatgtgaatgagtcgcgtcatcgctgtctcgtctatatactttcccagggcagatgatcttcacaggaccttgtcctttatatttttcaagtgtacgtgcttgaactggtgacgtttgtgttctgagcagtgtatcctcggtaatatagaagctgtcctgcatatcacgtgccggatgctcctttggaagattcagcgcctcaaagttataataatccgtttctacctcaggaccttcctcaacggtatagcccatgccaataaataaatcttcaatatcttcgacaacaatcgttaatggatgtcttgcccctattttgattgggcttgctggcaatgtaacatcgatcgtttgagacgcaagtttcttcttcacttcttctttttccagctgctcatttttttcagcaatggcaccagcaatctgctctctcacttcgtttgcgagtgcgcccatttttggtctttcttctgcggagagcttgcccattccgcggagtacttctgtgatcggtccttttttccctaaatattgaacacgaatgtcattgacttctttgagcgagctagctgcttcaaccttcgctatcgcttctaattcaagctgttttaacgtttcttgcatgagtgtaatcctccttttgatatacaaaaccgcctggataaacggctgtttgatcgtttgaagacaataaaaaaacccgtcccctctagaaaagaagggacgagttgtggtcgcggtaccacccttgttaagcacaaatatatgtgcgaataagcttcattgacataacggaatcaaacgaatccggttcacctttacgcaaagcttgcggtcccggtgacaactccagaggtgaattcctgtttcagcattccttaaatgcactttcagtctacgatgcattctccctataaggctgctccttgaaacaatcttcctctatcatggtttttaaaatattagtttcattatagtgaaaatgagcgcatgttgcaacactatccacgcaaatgataaacaagtacagccgctgcaacagccacatttaatgattctgcctggccatacattggcacatataaattgtggtctgtcatttgcagaatctctgggtttatacccgctccttcattgccaacaatcaatgcaaacggaccttctgccgttacgcttctatacgctttcgcattgtttagcgcacttccgtatacaggaatgtcttgctccttacatgctggtatgatctgctgaaggctttgctttaaaattggcaggtggaaatgcgacccttgtgcggaacggagcgtttttccgttatacgcatcaactgttccatcgcctaagatcacagcatcaagaccagcggcatctgctgtccgaatgagtgtgcctaaattccctgggtcctgcactgcatctaacagaagaagtcgttcatacttcttttcttcaaatacaggaactgtacaaactgccgcgatgtgctgaggcgtttccgtttcggtcatggcagaaaaggcttcctcgctcagttcataaagctcaatgtcaggatcgatatgagaaggaagcttatcaggcgatgtgaccattaattctttcacaaccccgctcttcaatgcttcttctactaagtggattccctccacgagaaacagccccgttttcattcgttctttttttgtatggagctttttccactgtttaatgtttgtattttttgctgattctatatatttcaagcgactttaactcctttaaatatcatgaatttattatatctcatgcacactacataataaacctgtctttgagacagaatagggctattaccatcaaaaaaggagtgtgggcaatggattttaatttaagaggcgcagtcattcaaaacatcactggccataatcaagagcagcttgagcatacgattttagatgccattcaaagcggtgaggaaaaaatgctgccaggtcttggcgtgttgttcgaagtgctatggcaagaagcatcagaaaacgagaaaaacgagattcttgaaacattagagcaaggcttaaagcctcatcagcagcaataaaagaagccggtttgctatcataagcaaaccggctttttcatttagccagtgatcggtgtttccatccgaagcgctggatcacgccaaatgtcgacccactttttaattgcaaacacaataatcacaaatcctaagatcagcataatgatcgacagcaccgcattcagcacgctgtaacctgatgcctcgggattaagatatacatttgctaccatccaatagcccgcataattcactgtcacatataagtaagcaagtggaattaaacaagtcagcatatatcgccttttatctgcaatttttaatacaacggttgctccgataataagaccgaccgatgccattaattggtttgacaccccaaacagcgcccaaatcgacccgatgtctccagagtaaagcaagtacccccacataaaacaagcaagcgcacttgcgaacaccgacccagggacccagtcatttcgtttaagcggtttataagcttcaccaaagaagtcttgaattaaatagcgtgccacacgtgtccctgcatcaatagcggttaaaataaagacggcttcaaacataatgacgaattggaagaaataagacgccaaatgaccaaagaacggaattcccgtaaagatatacgccattcctacagctaatgtcacagctccacctgttcttccttctaaatcaagaccaatttccttactcagctgcggaaggttctcgacactcatcccaagtgttctgaacacttctggcgtactgttgatcgcaaaataatcgcctggatgaagagccgtagcggcaattaacgccataattccaactagacattctactagcattgcgccaaacgcgacaggcttcatatcactccagcggtcaagcatcttaggcgttgtcccagatccaacaaatgcgtggaaaccagatatggcaccgcaagcaatggtaattgaaataaaaggccagacaggaccagctaaaacaggacctcctccattcacaaactccgtaaaggctgggaattgaatcgttggattgacgacaaagattccagcaatcaaggcgataaaaacacctattttcataaagctgcttaaatagtccctcggtgcgagcagcagccataccggcaatgccgcagcaaaaaaagcatagatcggcagagcaagggcaagcgtttttgtatcaagtgttaaaagctcgccaagtgccgtgccttgaatattcggcccaaggaatacaccaaccatcagcaaaataaatcccgcagttgtggctagttttaaattgcctgtctttttataataaagaccaactcccatcgcaattggaatcgtgattccgactgcaaatgtcccccaagggttacgttctaatgcatgaagcaccaccatagacaaacctgccattgtgatcgtaatgataaacagcatcgcaagccctgtacaaaatcctgcgacaggtcctagctcttccttcgctacctctgataacgatttccccttttttcgcatcgacgcaaataagacgacaagatcatgtacagctccgccaatcactgcgccaattaacagccaaaggagacccggtaaatacccgaattgtgcagctaaaatcggccccactaacggaccggcagctgcaatcgcagcaaagtgatgcccaaatgtgacccatttattagttggtacataatctttcccgtcctctaatgtgtgagccggtgtaggatgatcgtctgtcacctttaagaccttgaccatcataaatgtgccataaagacgataggcaatcgctaaaatacacatagatgctatgacaattgtaaccgcattcatttaaccatcccctttgcacaaacaatttgttacaaatataacataaattgattgatttttctttcttttaaaaccaagttgacaaatgtgaataatatgtttattcttgaggtagcttcacctacttccataaactctcttttgacagggcattctttaggctctgtcctttttattgctttcatcttacaaaaataaaagccagatcacatgtgccttattcactagaatattttttcttcttctgtcaaaaacagttcttttgacgtaatgataaaacagcgttcatttcctgggaaattcaaagaaataaaaaaagcccttcccctatactgaggaaaggcattcttacttaagaaccgtacgtgatttgttcaaccgttttttgatcaagtcttttgatcacttctgttaaaagcttcactgcattttcataatcatctcggtgaatcatcgctgcatgggtatgaatatatctgcttggtatcccgatcgatagagatggcacaccatgaccagttaaatggatgccgccagcatctgtcccgccgccaggcatggagtcatattggtaagggatgttcaattcatccgctgtttggacaacaaaatctcgaagccctttatgagataccatcgaagcatcaaatacaacaatcgttggccctttgccaagtttgcttgttgcttctttttcagtaatgcccggcgtgtctcctgctacaccaacatcaatggcaaaccctatatcaggctggattgtagccgctgctgttttggccccgcgcaggccaacttcctcttgtacagttgcaacactgtaagcaatattctcatgctgagtattgtgtaagttcttcatgacatcaatcgctactgcacagccgatacggttgtcccatgcttttgcaaggagcattttttcatcattcatcactgtaaactcaaaataagggacgatttgatctccaggcagaacgccccattccattgcctgttctttgcttgatgcaccgatatcaataaacatatctgtaatctcaatcgatttttttcgagcttcaggtgacaagacgtgcggcggctttgagccaatcacacctgtaatgtctccctttttcgttacaatggtcacacgctgcgcgagcatgacctgtgaccaccatccgccgacagtttggaagcgaatgtagcccttgtcatcaatttttgtcaccatgaatcctacttcatctaagtgaccagcgagcataattttaggtccgtttgcgtttccttcctttttagcgattaagctgccaaggcggtcactagagacttcatctgcatatgattctatgtatgtctgcatgacttttttgacatcacgttcatttcctggaatcccttttgcatccgttaggtctttcagcatagttaatgtttgatctagctttgtcattccatatatcctcctttatcttcatggtgcattcttattatacaaaacctttttcgttcaatacgatctttttatgaatattttttcgttttccgaaatatttttttaaaaaaagttgaaaccttttgcccttttcattcgtaatacatcagataacggtattggaggtgcatcctgtcatgtttgtaatcctcattagactagctcttgttgcactgcttgtctacatcttctacatggcggtaaaattcttctcaaacccgagaagaaagctgaaacaagcacaattaaaagaaggcttttattttatggacgaacagcaaaatgcacgtaaaaattttaatttcgtctataaaggtgtcttgtttgaaggggaaaagcatgttccttctaaggatcatcctctgtttgtccactccatttacgtttggacggagtcacctgagaagctaagtgaatttacattagaagactttgaaaaattggaggaaaacatcatcgaacgttatcctcaaacaaaaattgattgggatcagcccattaaaaaaatcaaacaaaaaaaaggagcagacacgccgtcttgatggcgtctgctcctttttcagatgaacttgatatatcctaatatgatcaactgcaccatgattaacactggcatgccaatttgaaagacaggatgttttgttttatgacgaaaatactgcatccctagatacgatccagcagccccaaaaagcacggcagcactccataagtgcgcctctgaaattctccatttatgcgcttttgcccggcgcttgtcctctcccatgagaaagaaaccatagccatttaccaagatcagcagcacaatcaacgcgatattcattcatttcacctcacatgatgagcaaaaaagatcacccctcaacggaatgatctttcatatgacttacttgtctagttgtgcttttgcagcatcagcaagctgattgaatgcacttaggtcattcacagcaaggtcagcaagcattttgcggtttacttcgataccagaaagctttaggccatgcattaaacggctgtaagaaagaccgttcatacgagctgcagcattgatacgagtgatccatagtttacggaagtcacgttttttctgacgacggtcacggaaagcgtagtttccagatttcatcacctgttggtttgctactttatataatctatgttttgaaccgaaataaccttttgctaatttaagaacctttttacgacgctgacgcgacacagttccgccttttactcttggcattgtaattccctcctatgattcctattccagattacttgatgtttgcaagttgttgtttaatacgtttgaaatctccagcacttacgattgcgctcttacgcaatttacgcttttgctttgtagatttgttagcgaacaagtgacttgtgtacgcatgagaacgtttaagtttaccagaacctgtttttttgaaacgtttagcagatccgcggtgagttttcatttttggcattggatgtttcctccctctgttactttacttttcgacttttggtgcaagcatgaggaacatgctacgtccgtccatcttaggttttgtttctactgttgctacttcagcgcaagcttcagagaaacggtctaacacgcgctgtccgatttctttatgcgtaatcgcacggcctttaaagcggatagaagctttcactttatcgcccttttcaaggaatttgattgcattgcggagcttcgtgttaaaatcatgttcatcgattgtcgggctcaaccgaacttcttttaagctaatgattttttgattcttacgtgcctctttatccttcttctgctgttcgaatcggaacttaccgtagtccatgattcggcaaacaggtggttttgcatttgcagcaactaacacaaggtcaagattggctttcgtagcaatttccagagcttcctggcgggttttaatccccagctgatcgccattttgtccgatcaaacgaacttcacgcgcacgaataccttcattaactaattgatctttgctaatagtgagccacctccatgagattttgaattgagttcacaattcattttgaccatttcgttgtatgttttacaggcaaacaaaaagtgtgggcatataaaacacccacactgcgaacatttgcatgaaaaaataaatgtacggtcaacctgtcaactacaaacacgtgtcaatcaggtgagaagcgggtgcttctgcttgtgatatctattcaattcgttaattattctacacaattttcattcgtccgtcaagtaaccgaactcttgaaacaactttttcatcttagcatgattaaacgaatagggcaaggctttttcaaaacaatgacgccatcaaagaatgaattgcataaagattgggatgacaatgacggtcacaactcctacgaccacaacggcgatacttgccatggccgcctccacttcacccatctcaatcccaacagagacgccaagtgcatgtcctgatgtaccgagtgcaagcccttttgccactggatttttaattcgaaaccattttaagaagaaagcacctagtgcatacacgatgactgcattaaaaatgaccgcaaaggctgtgatatctgcaattccgccaatatcctttgcaatcggaagagcaatcgcagtcgtcgctgcctgcgggagcatacttttcattaccgctgcatcaagatgaattccttttgctacgacatacacaattgtaatggaacaaagtgatcctacaaaaatagcggataaaatctgccaccaatatttttttagcaatgcacgctgcttataaagcgggatagcgaaagcaatggtcgcgggctctaagaaaaacttaataatcttgccgccctcattgtaatctgcataggaaaaaccgccaatttttaaaaataaaatacctaacaccatggccacaaaaagtggtgtaaataagaagaagccttttgattttttaaataagaatgtaccgattccaaaggcgactaatgagacgactataccaaaataaggactcatcgtacttgtacccatcctgcatctctcctttaatgcgtacttgaagctggtttattagaatgagaaggagtcgatttgctctcctttgtctctttacgtttctgtggtttttctgataattgcaagagaagctgcgagaatagccctgtcgctgcaagtaacataatcgttgcaatgatgatgacaccaacgacttgcacacctacttcttgcatgacacctagtgattgaataaccgagataccagagggaacaaatagaaagctaatgagccctgtcaatgatgtacctaattgctccacttgctccagtttgacgattttcgttgtcagcaaaacaaataatagaactagaccaatcacagatgcaggcatcggaattggtaaatacattgaaatgagattagaaacgaacattacggttgcaaagataaatgcttgagatagaaatccatatactttagtggcactcatgccccttcacctctttcttcgactgccctcagtataaggcatgaaataaatgaatgaagcgtttacaatcaaactcaccagattcaatgaatgaaatgcagaaaacgagtattgaaatacaaataaaaaaagccgtcctattctagcaggagcgacttctttagttctttggcgtaagtacggctgactggaataatcgacccgtctgtcatatgcagattatacgtcgaattaaaccacggctgtacttctttcatatgagaggtgttcacgatatagcttcgatgaaccctcataaagtaagcctcagggagtttcttttcaatgaccacaagcggttctgtgacctcgtacatgtgatcctttgttttcacaacctttttcccctcactaagcccaacatacatgatctcttctacttgcagaatgacaattgagtcatcgactgagatggctaatttttgctgatggggaattttctcatctgacagctgatggtctcgcgtctcaacagacttccactttttaaacttttggatcgtctgcaatagccgttcttcatcaaatggttttgttaaataatcaagcgcactgacctcaaacgcctttagcgcatattgatcaaaggctgtggcaaaaacaatcgctggcggatctgacattcggttaagtcttttggcaatatcaaatccattttcacctgataaatcaatgtctaaaaagagcaagtccggcttatgatccaccatccggtcaaaagcagattctatattttctgcttcctctatttgaacatcctctttcgttctgcgtaataagtattttaattcgtctcttgctaacacttcatcatctacgattaatacgtttatcaacgaaaatcatccttttttacatagtccattggaatgcggaatgagatgtcagtgccttggccgctatgaatagatagagcggcttgtctgccaaaaatccctcttaaccgctgatctaaattgaaaagagcggtacctgttccttctttggattcaacaggtgcttttaatagctgagccatcttgtcattctcgattccttgtccattatccgtcactttcatattgacatgcccatctttcatcacagcagatacgatgacttcacagctcgtttgatgtttaggaaaagcgtgtctcactgcattttcaacaagtacctgaagcacaaatggcggaatcatcacctgctcaagctccttttcaatttgaaaggtcacgtggtatttatttggaaaccttgcttgttcaagtgacaaatatgcttctacatgctgcatttctttatgaagtggaataagcagctggcgggcgccttgcaaattggatcgaaaataaatactcagctgcagcagtagtttcctagccatctctacattcgttctgcacaagacagagatggtattaatggcattaaataaaaagtgcggattcacttgcgcttgaagcgctttgatctctgcatcttttagcaggcggctttgggtttctgcctctccaagctcaagctgtgtggaaaacagcatcgccaagccttctgcaagctcctcttctaccctgcttaatccgaccggagaattaaaatacatttttaacgttccgatcgtttgaccattagaggtgaggggcagcacaatcgccgcttggagcggacaatgggtgactgaacaattgatttcgtctttcgaatgcgccttcataattttgccgctcatcaatacttgtttcgacagtcctgtaatcaggcttttcgatggaatatgatgatccgtcccatctccaacatgcgctaaaatcttttctgtatcggttaaggagaccgcatctgtttctgttaatcgatgaatgatctccgccacacttttacatgactgttcatttaacccttggcggaagaaaggcagcgtttgatcggcgattgaaaatacacggtgtgtctgcatcgcctttgcctgctcttcttgccgaatgactgactgtaaaatcgataaaaagataaagctgccaattccattcacaaaaatcatcggcaaagcaatgatacttacaagcccccaagcatcagcaaatggctttgcaaatagaaggataatgatcatctgcaaggattccattgccacaccaaaaagtgcggcttggcgaggtgtcaccattcgattcttccgcttaaacctgctgccgacatagcctgcaatcacaccggctaaaatcgaagaaatcgcacagctgagtgccgtgcttcctcctaatgaatagcgatgaatcccagctaaaagccctgcgccaatgccaacaaatggccctcctattaatccgcccatttcgatccccataattctcgtattggcaatcgaacttgatgagccgagatgataggaaaactcatgattcatgaccatctgctgctggatttcaattcctgtgtaattgctgataatactaaaagaagcaaaaataaagacaaggactgccttttttcgaaccccttcattatgaagtaatagattgcgaaaacccttcacatgggcaagcacaaaccctaaaataacgatgatcccaacacgctcaatcatcataataattaaatgaagcaaacctgccacctcaattgatgtatgtattatttactgtctttctattttatcatgtgcggtcaatgttcaaatatctctcaaatcttttctttattgctcacatcttctattgtaaaatgaacttgagccgtcacttgcaattgaaggtaacacatacataacaagggagaagatcatgaaagccgtatttttcgatttagatgatactttgctttgggatgaaaaaagcattcacaccacttttcaggaaacatgccgcgaagcggaaaagaaatatggactgaatccagaaacatttgaacagattgttcgtgaagaagcaagaaagctgtattcgtcctatgaaacatatgattatactgtcatgatcggaattaatcctttcgaaggactgtggtccaattttagtgaaccgattagcgaaggctttcaaaaattgaatgcccttgcaccagagtaccgcaagaacgcttggaccaatggcttaaaagaagcaggaattgacgatgaggcatttggacaatatttggctgatttctttgcagccgagcggagaaaacgcccctttgtctatgaagaaacgtaccctgttttagaccgcctgaaaggcagctatgaattgctccttttaacaaacggagatcctagtcttcaaaaagaaaaactggccggtgttcctgagcttgcaccttattttaatgaaattgtgatttcaggagattacggaaaaggcaaacctgaccctggcatctttgagcactgccttcagctgttaaatctaacaaaagacgatgtgatcatggttggagacaatccaaaaacagatattcttggggcatctcgcgctggtattcaaaccgtttggatcaatcgacatggtaaaaagaatgaaacagatgtaacgccagattatgaaatcaaagacttacatgaattgtttgatatattaaaatagaacaaatgaaaaaacacccttctcctgacgagattgggtgttttttgtgtgctcaaactacacaattcctgctagactttgcgcttgcttgtctaaactgcgggctgcttctcctatattgataaattcctcgtttgcctgcttcacaagatcacgatttgtaaacaccgttgttttggcccggctcgttccgttgctgaccttctctacttccgcatgaatcgcctttacatattgatctactttgacgatcgcttcttttgaattagttgcaagctttcgaatttctgccgccactacactaaagccatttccataggaacctgcgtgggctgcttcgatcgccgcatttaatgcaaggagctgggtttgtgaagaaatgctgttaatcgttgtagcgatggagctgatggactctacctgctctgttaatccttttagtaagctcatattttgatctgtttcgtttgctatatgatcaaaggagacattgactctttgactatgctggatgcccacttctgctcgctccattaattttgcagacatctcctttaaatcgtctacgacctgtttcatcgtgttttctctttctgttatgtctgttgcgactttcacaacacccactatgtttccctcttcattatggacaggtgtataggttgcttcaagccataagctgtcaccattcttcgtcatccgctgcaccttttcctgaaagacttgcccctctttcaaacgcttccaaaacatttgatagcttgcgtgctctgcaatatgacgaggacaaaactgtctatgttttaaaccaatcatctcttgctttgaatatcccatggcttttgcaaaaatatcattgacccataggacttctcctgtcacatcaaattcaatcatcgccagtgagtgttccaatgcacgaagtactgctgatcgctccaatacttgtgatgataaagtgtttgttgtttgcatcatcgctttcattcccccaatctaactcgaaccaatagtacatacttacccatactttcgtactatctaaacgtatcattcaagggactggatcaccagtggaggatttttcccaagaaaaagccagtgatctaaagagaaagatcactgactgcttcgtttgaaaaagattattttttcgcttctgccactgcatgtttcacaaaggcttcaagatccatcgtttctgaatcttgctctccgtattttctaacattgacagcgccattttctgcttcttgatctccgacgacgagcatgtacgggatcttttgcatttgcgcttctctaattttgtatccgattttttcatcacggctgtcaagctctacacgaagaccttcaagctgcaaacgttcttgtacttttttcgcatagtctaaatggacagacggtgaaaccgggatgacttggaattgtacaggtgccagccaagttggaagggctcctttgtattcttcaattaagaaggctacaaaacgctccattgtagaaacaacacctctatgaatcacgactggacgatggtgcttgccatcttctccgatatatgtgagatcaaagcgctctggaagtaagaaatcaagctgtacagtagacaatgtctcttcttttccaagagctgtcttcacttgaacgtcaagcttcggaccataaaatgccgcttcgccttctgcctcataatagtcatgaccaagctcgtccattgcatcctttagcatcgattgcgctttattccacatggcatcatcgtcgaaatacttctcagtatcttctggatcacggtaagataagcggaatgtgtagtcattcaagccaaagtcttgatacacttcttcaattaggcgaactgtacgaatgaattcgtctttgatttgatctggacgaacaaaaatatgtgcatcgtttaatgtcatacctcgaacacgctgaaggccggataaagcacctgacatttcataacggtgcattgtaccaagctctgcaatacgaattggcaattcgcgatagctatgcggctcgtttttgtaaatcatcatatggtgcggacagttcatcggacgaagaacaagatcttcgttgtccatttccatcacagggaacatgtcttcttgataatgcgcccagtgccctgatgttttatacaattcaacatttgcaagaactggtgtatacacatgctcataaccaaggcgtacttctttatcaacaatgtaacgctcaataacgcggcggatcgttgcgccttttggcagccaaagcggtagaccttgacctaccttttgagagttcgcaaacagtttcagctcttttcctagtttacgatgatcacgttctttcgcttcttcaagcagacgtaaatgctcatttagatcatctttgctgaagaaagctgtaccgtaaatacgctgaagcatttgattgttgctgtcacctctccagtatgcacctgcaaggcttaacagcttaaactctttgatttttcctgttgatggcaagtgaatgccgcggcagaggtcaaagaattcaccctgctcataaatcgtaacagcttcaccttctggaatcgcctctaacagctcaagctttaattgatcaccaatcgcttcaaagcgttttttcgcttcttctcttgatacttcaattcgctcgattggcagattgctgttaatgatttttttcatttctttttcaatctttggtaaatcttccggtgtgatggcaacatcgatgtccacatcgtagtagaagccattttcaatcacaggacctacgccaaactgaacgtgatgctcttttccatacagacgtttgattgcctgtgctagcaaatgagctgtgctgtggcgcataatgtcgagcgcttcatcacttttatctgtaataatctcaattgttccactttctaatagcggcgtacgcagatctatttctttgccgttcaatttaccggcaagcgcttttttctttaggcctgggctaattgatgccgcgatgtcttctgttgtagctgttttgtcaaactccttgactgctccatctggaaatgtaagttgaatttgttctgacatctctggtcactcctttttttggcaatataaaaaccccgccccctggaaagggacgaggttgaataaaacggaatcgtggttccaccctttttcccgtatttgcagcttactttttcataagcaaacacggcttgtggttcgataacgggaattcccgtcagccattactaaaacgttcacagctgatgttcaaaggtggtaaagcaaatggtcctctgctaggaagctttcagccgcggcttccctctctttaagcgggtgttcatttgttcatgtccttatcaatacggtctctgtatgaagttacaccgtattataaaacgttttttcgtgaaaatcaagaaagcttttcacttttctgttccaaatggtcatggacaaattgaacattgtgttcttgaaatgaatgagccgggaatacctcgaccctttcttgaaaaatattttgaatggtctgtaccatcgagtgacctgtatcatttgtaaacagatcaatcttttggggcgctatggatacgagtggtgcaatcagctgcgaatcaatatacattggatgctctcttacaaactgtctgtctatgtattgtttttgatcacgctcagaagcgtaccgaaattcccaaatcatcaggcgatcctgatgcacaacatgtactttttcgagctttggttcttttgccatcacatagtctcgaagcgattgaatgaagttttgatattcttgttccattttgtattcttcaatggagacttcaacatagttcttcagcctcctgtcatactctgacagtctgaatgtcataaatgaaccaattgaaaaaataccttgctgtaaagaaatcgtctcaagctcctttgttaacagggcttctcttgacggttcttgatgaatgccgggaatatcatctaaatccccattcatgatgctgtgggcgatggaaagaatttggtgctgctcttcaggatctttaaataaatacgtgttttcaagaatgctgcgcatgcgctcattttctttgcattccaaaaaaaagtgaaccagtaatggccgcacaataggctcaagtccttcttttgattccttcgcctctatgagaagccggtctttcccttgttgaattgacatgtgatgccgactgtccaagtgttcagcaagatgtaaaaaagcggcggtatcatattcatcttcaaagattatttcaagcatgtttgtcccccctaacgacatctgttacatatatatggggagaacataaaaaatagacgcctaaaataaatcaggcctctttctttttaaaataagtggaactgagataaagatcagataaatcaaacaaacgattgctaaggcggcataattgccgctgacaaagcttgatccaaggacatttaatgccactgtacccggtattaagcctaaaaaggtagctgccgtaaatgcacgataattcgcacgtgaagctgctgccgcatagctgacaaagtcaaaatggattggggcaatacgcaataacaaaatgtaaagaaagccatgctcctgaatgcgggatgtcaccgctctcagcttccggctgcttgattctgtttccttctttttggagcgaaaggttgtggcaagcaggaaggagcctgttgccccggcggtagcaccgacgagtgcataaatcgtcccaagaacacttccgaaggccaaacccgctgccagcgaaaagaccgtaagtgggacgagaacaaacgggcgaaaaagagataagaaaagaaaaacaaagggggccagcaatccaaattgaagcacccaattcttcacatctttcggtgccagctgaagatgctgtttgttcagccaccaaagtaaaacagcgagacctgcaatcacgagaaaaagcagccattttcttttgttcatttcatttgctcctccttcacgtgatagacgcttttataaatgacggcggttttctccttcgagcaagactgcctctgctaaatagagaatccgttccattaaacgagcggctttgacctcttctttttccccgcgctgtgagtacgtaaagtgatgcttcagttcacttggtgagaaattagaagagaagaaagtcggcagctgctctgccatacggtattgtaaaatcgttccgagcagttcatcacgaacccagcttgtcatcgactctgccccaatatcatcaagcattagaataggggtggatttgaccatgttcaattttgattctaatgtatgatcggctaacgaattttttaactctctcacaaattcaggcacgtacacaaggagagatggatattccttctccgctaactgctgcgcaatggctgccagaatatacgtttttcctactccaaacttcccgtgtaaatataagcccttccctttgcccgtctcatcatagctttgcagaaattgtcctactttttgaatgacttcctgtcttcccacaacgttcagatcagcaaacgttgcttgaagaacattttgcggaatgtacatgcttttcatgagctcttgctgttttttctgtctatcgagccgcagcttgactggacaaggggaatattcaatatcaatactctgacctttgatcacaagcttcgggtgataaccgtctaaaatcgcattgacgttctcttcatctaagcaatatgaacagcccttcgactgctgcacatattcaaaaagccggttcaagctgcgattgatcatgtcttcgtgtatgtcttcttggtgctcctgtaaaaaggcttttacgttttcatcagataacacactctctttaatctgattgtatctcacacgaaaatctacgcgcccttttagctgttcaaatgaacgaccgatcggtttcatcctcatctcacctcatcttaatgtgcattgtactttttcatatttttaaactgatctaacagtttttctttttctcgttcgaggtcttctgtcgataggctgtctgtttgttcttttgccggctgttctttcgtttcagtttctttcatccagtcaggaagcttctcttcacggacaactttccctgatccgtacgtgctgcgctgctttttctgctgcgcccactctgtcatttgcctgttctcttctttggcaattttcatggcagccgctacggttttaattttctttctcacccaatgagcggcaattttttgcatatatgttttcgacagcttcatatctgttttcagtaatgtatagtagatcaaaacgttcatgacacctggctccagctgctgctcaagcataatatcttcgacaattcttaagtcggcatatgttggctcaatgccgtcagccatatcttttagcagctccctaggcgaaatatgatcaagcttttcaatcaattttgcatctggcgtatctaataccggcgcttttgaagcatcttgacgcaagtgtctcggctgtttttgatcaatgagttttggctgctcgcctctgtattcaatttggtaccagtctcttgctgcttttctcagttcttctgttgagatcatttgatcagaaccgcaggcacctgctacaatattttgcatttgaagcggggtgatgccgtatacaaccgctaacttcttaatggtttctttcacctgcttagtcaaagcctttcttggaatcatcatatcagacatgcctgctaacaatagatcgaaatcaaaggaatcgtctgagagcggagcaggctgactcgatccaacggtcacatattcatagccttgatcaagtgatgacgcctgattgatttcttctgtcatcctgcgttcacctggctgcaatacgtgaaagacttcttcaaacgaccgcgagatgttccttgcctctgctggaacaccaggataagagaaataatcacgaagctgcatatatttcgctttctctacacgatggtacagcaggacattcagcataccatcttggaaaaactcatctggtcttagcggcggtacaagctcatatgtaaacagtctgccttcttccgtttcctgttcatatgtgcgcagtaaaccaatcgcttcaagctttaaacgttcctcaaaaatatcattcaaattcgtttgcagcatgaccatgagctgccgatgaggtgcgggtttcccccacatacgattttgttccagctctccccacagcgtcatatataagctgaaagcggacatgcctataagcggctgatataaaagagtgatgagctgtctatcgatgtcaccgagcaatgaagcgcttttgacgacatacggatcgacggctagcacttccttccaatgctctgtcatatgctgatcctccccatgaattgcaattgtttctattgtacaccctttttacgttttacgctttacgcaggaaaaagagcgtgaagaatcttcagctcttttttagcgttctttctttaataaatcttttaattcatcaataaagacattgatatctttaaactgccggtaaacggaggcaaacctgacgtaagacacttcatcaatttttgccagctcgtccatcaccatttcacctacaagctcacttttcacttctgacataccttgattacgcagttctttttcgatattaaagcagacatcctccagctgctttaaagcaactggacgcttttcacacgctttaatgagtcctctcagcatcttttcgcggctgaactcttcacgaattccttcttttttcaccacaatcagtggtaattcttctaatttctcaaacgtcgtaaagcgatattggcagctttcgcactctcttctacgacggatggatttcccttcatctactggtcttgaatcaagcacccttgtaccaaggtgctgacatgtgggacatttcatttcatcagctccgatctattcttggaagttgtttgtctagttcatcataaagggaaaaaaccgttttctcactatagccaaaatctgttggcagtgctgtttctgttgtcacattaaaatcgacagctgtttcaaaaggacgaattgaaatgacagtcgctacgagaaaggcttttttcggcattgtgatgttggcgctgatttcacctcgttctgctgaaacagatgtcacttgataggaagcgtgcccggaaagcatggcttccagcgcttgaaaaacttgcgcattcgtcgatttgtagtaatggcttttcagttctgatagtggatgctcgtcagatgtttctgtatggtttgacatgaaccgtttgaacttttgccctaaagtcatatacgtatcccctttgccataatacctcttctttattttataaaaaaaacctttgttttcctagaacaaaagtataggcaagttggggaatgttggattttctctatcaaacaaatataaaaaggagcataacacaaaggcatttcaatgcttttggccagctcccattgcgatctttttttatgtttacagtgctttggcttgtgcctgtttcacttgtacaggtcccatgcctcgaggaatttcaatgttttctcttgtttcagcgcctaattcatctccgatatgatctgctgcaatattcggatctaggtcgccgcaagtataaacatctatgctcgcataaccatgttcaggaaagctgtgaattgtcagatgagattcagaaataatgacaactccacttactccttgaggtgcaaatttgtgaaaagcaacctctcttacttcagctcctgatttcaaagctgcatttacaaacgttttttcaataaaatccatgtcgttcagtttatcacagtcgcatccccataactcggagataacgtgacgtccgattgtttccatcatggaccccccttaaacaagaatgaaagagtgaagttctaagcagccggaccggacatataccacgggggaaagttagtccaaagaggtcctaaccctttaagtatacccgaatgagtctgcgaacaagaagttcacgaaaaatagtatactttgtttagacccattttgcaagctgtgttttcaatgggattttctctcatttcttgaaaagggacgttcgtcttcttcatttcaaacagcagaaagctctttcatctgcgacccaacaaacttcacaagatccaccactctgcatgaataaccccattcattgtcataccatgcaagaacttttacttttctatcccccatcaccatcgttgtcagtccatctacgacagctgaataagggttcgtattaaagtctgtagaaacaagtggctcatccgtgtaatctaaaataccggatagagaagtttttgatgcatttgagaaggctgcattgacttcttctgctgtgacatcttttttcaagtcaacgacaagatcaaccatcgatacgttggagactggcacgcgcagtgcaagtccatgcaatttccctttcatgtgcggcagcactaaagaaagcgctttagcggcacccgtcgtagttggaataatggactgggcacatgctcttgcccggcgcaaatccttatgcgggttatcgatatttttttgatcatttgtatacgcatgaaccgttgtcattaaaccgttgtcgatgccgaattcatcatctaacaatttgacaactggtgctaaacagtttgttgtacaagatgcgtttgaaataacgacgtgcttttcaggatcaagatcatcctcattgacacccattactattgtaacgtcttcatttttacctggagctgtaagtacgacctttttcgctccggcatctatatggcccatcgcttgatcttttgaattgaattttcctgttgcttctatgacgatatcaatcccaagctctccccacggaagctgctttgggtctctgttattgagcaaaagaactcttttcccatttacaatcagggcgtcatcttctgctgtcacatcgcattcgtaacgtccatgatttgtgtcatatttaattaaatgtgctagcgtttcggcaggatagcttgcgttcaccgctacaatttgaatttgatcatcaagcattgcttttctgaagaccatgcgtccaattctgccaaatccattgatcgctgcttttaccttcatgaacaggtcactcctctattatgtgttatactcaataaatttatttatgaaattagtatatcacattagaatgtaattgccagtatataaacgtatattttctaaaaagggctgttcttttcaaaggaaatcagaataaagcataaaaaaagaagagtacgtgtatgtactcttacttatctgtatgttcccattcatttaatatgttctgtaattgctttctgataaaagcgagatcttgtgtattttcaatcacccggtctgctttcttacatttttcctcaagagggtgctgagagtgaatccgattcagtgcttcttccgcactaaggtcgtttcgattcatgagtcgtgatagctgtaattctggtgttgtatataccacaataatccgatcgacaagactttccagctgactctcaaataaaagcgggatatccaggacaacaaatgtttcttggctgtcgattccttcatcacgctgcctgagcatttcctttcgcacttctggatgaacgattgcatttagctgctttcttttctcttcattagagaaaataatggctcccagctgctgccggtccagctctccatttgggaggaggacaccctcaccaaaggtttgaacgatatgatgaagggcgggtgttcctttggcgaccgcttcttttgcaatcacatctgcgtccacaacccgtatgccatgctcttttatcatctgcgagactgtgctttttccgctagcaatcccgcctgttaatccaatgacaagcgtcaattgatttcctccttttacagcttccaaaccccaattaatatgagcagaagccctggtaaacatgcgagtttatcgatccagcgccaatttgccaagtaatgaccggctcggagcccgatacatacaaaaagtgagctcatcactgcgaccgtgatactcatgacaatgggagaaaagcctagaatcgctgcgccaatccctgcgccaaatgcatcaatggataaagcaattccaagaagtaacgcttctattccattaatcgtcccagatcggtcaatatctgcacttgtcggctttcttaaaatgtgaatgacaagcccaagcgattggacttccacattaagcaatgtcttttcatgaagaagcaaatcgcgctctttcgctggtttataaaattgatacaggacccaaagaccaatggcaattaaaatgcctccccccagtttatcggtcactgagacagggagaaatgtcgtcagcaggctgccaatcagcatagaaatgagcagcacaatccctgagcagcatgcaataatgacgatggctttaaatgggattctcattttgcgaagaccatacgtaaaacctacagaaaagctgtcaatgctgactgcaatagctaaaaacaggagcgaaatcgaaatcatacctgaactcttcctttctgttcatgcaacgatgatcaagagtctctaggcgttcttagactcttctccactatatgaagagcaggtgggctgtgtgtcagtctacaccttgctgaaaaatgaatgttttttatcgtatgcatcgcaaaaaggaagcatgcgcatggttaagctttattggggacgtttttggcaggtcacacaaaagtgcgtgccgcgccctcctactactgttttctcaataatgcttccgcatgtttggcaaggctctccccgccggtcatacacaagaagctgcagctgaaatgtgccaatatctccttgtgagttgatataagaacgaatcgtacttccgcccgcatctaccgccacttgaagcgtatcgatgatctgtttgtgaagcactttgcaggattccaggctgagctgattcgctttcgtttctggatgaatccctgatttaaacaggatctcatctacgtaaatgttaccaagtcctacgacaatcttttgatcaagcagcgctgttttgaccacgcgggttgtttttttcaattgctcccataaatactcaggagtgaactgtttatcaaatggttcatatcctagctgtgatagcgggagttccttttcctcttcacccggctgaaataagtgcattgtgccaaatttacgcacatcatggtaccgaagctccgtcccatctgtaaacgtaaagacaacgtgtacgtgtttatcataaggctcatgcgcttcatgtacacggtatttcccttccattcttaaatgggagaccatcacataatgttctaaatgaaagaggaggaacttccctcttctttcaatggtttgtatggtttctcctaccattcttcttgcgaactcttccggctccccaggacgtttgatgatgtttggccatttgatatcgaccgtttcaatcgtctttccttcgactaaccgcttgagagtgcgccggacggtttcaacttctggtaattccggcatgctcctcgctcctttttctctctatgatttatttcgcatcgtaccaagatggacctgaagcaaaatcaacttttagtggcacatcaagctgaagtgcattttccatgacttcaggaacaatcttttcaaggatcgcaatttcttcttttggcgcttcgaagatcaattcatcgtgcacctgtaataaaagatttgtttgcaggttttcttctttgagccttcgcgccatatcaatcatcgcctttttaataatatcggcggcgctgccttggattggtgtgttcatggctgttcgttctgcaaagcttttaatattaaaattacggcttgtgatgtccgggatatatcgtctgcgtttaagaagcgtcgtgacgtagcctttttgtttcgcttcctggacgatttcttccatataggttttcacgcctttaaagcttgttaaatagcgctcgataaatgcggctgcttcttttcttgtgatcccaaggttttgagaaagtccatagtcgctgattccatatacaataccgaagtttactgccttggcttgtcttctcatagcggaagtcacttcttcttctgagacatggaacacatccatcgctgttttcgtgtgaatgtccatgtccctcgtaaatgcttcgatcaaattttcatcttgtgaaatatgagcaagtacacgcagctcgatttgtgaatagtcagctgcaaacatgagccagccttcttttgaaggaacgaatgcttgacgaatcttccgtccttcttctaaacgaatcgggatgttttgaagatttggatctgttgagcttaatcttcctgtttgcgtgagtgcttgattaaatcttgtatgcactttatgggtatccttacgcgtaactttcattaacccttctacataggtcgattgcagctttccaatttgtctgtagtgcagaatggaccgaatgatttcatgcttatcttcaagcttttcaagcacatctgcagacgtcgagtagcctgtttttgtcttcttaataactgggagacctaatttttcaaaaaggatgacaccaagctgtttaggagaattgatgttaaacgtttctcctgctaagcggtgaatggtttcttcatattctttgagctttttcgttaattcctcacccattttctctaggcgttttatatctacctttactccaagagattccatttcacctaagatgagtgctagcggcagctctaaatcttcatatagttcatgctgatcatttttttctaatgcttctagtgttaaatcatgcaaggctgagatcgccgctgcctttcgtccaagatgttctttcagttcatcttcaggtggaatcgcctgttttgctccttttccgtatactttttcatcagaaagagcgatattcagaccatactccttcgctacacttgcgacgtcttcgtatgatttctgcgggttgacgacgtaggaagcgagcagaacatcattgtcgacaccttttaggtctacatcatgccatctgagagcgacaactgctctttttgaatcaaagacccattttttcttcgtttcatcctgtacccattctttaaatgcatctgattgaagtgcatcttctttcgtcataaaaaacgcaccattttcattatggatcgcaaaaccgatcaaatccgcttcgtgataattatctccaagctgttctaccacaagggctgcatgatctgtcagcatgtcgcctcctgcagctgtcattttcttcacttctaaagcatctacttcaacctgttcatctgtttctggtgcttctcctagacgctctagcagcgtttgaaagcctagttctttataaagagaaatcacttgatccatgtgtggaccttcgtaggcgagatctttgctcgacacatcgataggtgcttctacgagaatggttgccagctctttactcatgactgcttgctctttatattcttcaagcttttctttgagctttttcccgctcacttcatcaatatgttcaagcaggttctcgactgtttcaaactgctttaacaatttaatggctgttttttcgcctacacctgggacgcctgggatattatctgatgaatctcccatcagccctttcatatcaatgatttgatctggtcgcagaccatatttttcttcaatatgagcaggtgtatagtattctacttctgtgatgccttttttcgtaatagccactgtcgtatgatcagttgagagctgtgttaagtctttatctccagagaagattttgacttcaaagccgtctttttctgcctcgacagccaatgtaccgataatatcatctgcctcatattgaggaagctcgtaccttttcacctgataggcatctaatagttcacggatgaacggcatttgttctgataactctggcggggttttttgtcttccgcctttatattctttaaatgtctcatggcggaatgttgtttttcccgcatcaaatgcgacgagcatatgagttggcttctcgtcctccagcattttcattaagatcatcgcaaacccataaatagcatttgtatgtacgcctttatcatttgataatagcggcaaagcaaaaaaggctcgatatgcgagactgtttccatccactaacactaatttctttttgtctgtcatgttttaatcctccatcggctgagccatctcagccgtctctttcacacattgtatcttcattttatcaaagtttattttgaaaagaaaatagtcgagcctgcataaaaaagggacgaaaacaacaagtgttttcgtccttccaaaattggctccttggatgaaggggttcctattcatcctatcaatgaatgtttaacaaaacatgaattcattgtaaagatcatgtaaattttaacgtgactttccttttttctctatgttgatttcaggctcactgtaaaagtcgttcctttaccttgtttgctgcggacagaaattgttccttcatgcgcttccacaaggtgtttgacaatggcaagaccaagacctgtaccgcctgaattcctgcttctatctttatcaattcgataaaatctctcaaatattcttggaatctcacttttcttcatgccgattcctgtatctgctacatcaaattcataggcaccttttcgcggtcttgctgtgatggtgacactacccccctctggtgtataggtaagggcattattaacgagattgaggaagatttgctttaaccttagctgatctgccatgacatagaccggttcttttgggacacgtacatgtagttgaatgcctttttctgtagccttttgacttaacagcacttgaatctcttggatgatttctgtcgcattggcttcttgaatattcagcttgaattgctgctgctcaattttagaaagatcaagtaagtcttgaatcaatgtttctaggcggacactctcctttaaaatgatagaaaggaattctgtcagtgcttctttgtcatcaattgcgccatcaagaagggtttcagaaaatcctttaatcgacgtaatcggtgtttttaactcatgagacacattagcgacaaagtcttttcgcatctgctccagctgcttcgtttctgtcacgtcatgaaacacgaggacaattcctttccattcatcgtctgtacttaaaatgggtacaccatccacttggaagtagcggcgttcaatgtcaacggctagacgtaaaaacttccgcaccttcgtttctgtcatgaaaatttcgtcaattaattcgataatctcttcatgggtaaacgcttcgtgatacagcttgtgcatgtaaatatgcttttgcaccttaaactgcttgcggaaggttcgattgacgaggtggatataccccatcttatcaatcaatataatccccgctccaatattttcaatgaccgtttgcagccggtctctctgcatttcaccggcacttgtcatttcttgaagacttcccgccaaacgcttcatggaagtattcagttcacttgtttcaatcatcagctcttcgtaattattcgtatcatagttcccgcgttctagctgtttggctacctttgtcgcataatcaattggtttcacatatttcatcgacatgcggtacccgaagaaaacaatgatgatgatcgccgagccaagacaaaaggctaaggcaagccaaagctggccgtcaatttcatttaaaggctcgtatgacgcatggagaaataaataacccgccggttcgttttgttgttttaagatcgggacagcataatggaacagcgcatctttctcatcgtcaataacgaccccttttgtttggagacgttcattgttcagtgtgttttgaatgatggccttttgttctgcttgacccgttgtatgtatgatattcccctttaaatcgacaatcgacgcattcatatcaaaatgctgctttgcctggttgaggacctctttgttttgcttcgcctttagatcatcaccattcatagaagacaggagaaagctcgattccttttccattcgttccgttaattttgtttcatagaaaacatggaacatgtgatccaagaaaagaccaagtgccacaaacacaataaaaaggagaaaaatgagtcccgaaaacagacgggttctaattttactcatttggctttggctcctccaatttgtagcctaagccgcgaatcgttttaatgtatgttggttttttcgtgttcttttcaattttgtcccgcaagtggctaatatgaacatccacaatacgagtgtcacctgcaaagtcataattccaaacggcacttagcaataaatcacgcgtgaggacacgtcctttatgcttcgccaaataaagcagcagttcaaattcttttggcgtcagctctagacgttcttcctggaaatagacctcgtagtgttccggtaaaatacgcagttcaccaattttgatttgatctgcaatcatctcttccttctcctcttgcgtgggggcaggctgagattgctgtgctcttctcaagatggcttttacccgagcacccacttctctaggactgaatggctttgtcatgtaatcatcggccccaagctcaagacctagcaccttatcaaattcatcgtcctttgctgtcagcattaaaatagggaacatcattttttgaattctcagttgtttgcacacttcaatgccgtccatcttcggaagcattaaatctaatacaatgagatcaggttgttcacttgctgctttttcaagcgcttcttccccgtctcttgctgtgacgacatcatagcccgctctttcaaggttatagcttagaagtgttacaatcgattcttcatcatccacaactaatatttttttattcatgttgtgcctccaattagtgatttcccctgcatccttttttgtatcttatgtgaaaagcgagaagtcatgctttctctttcattttaacgaaagcttaacaagagaacaatttaaaatttcgacaagatttgttttgtaaacaaaaagaagactcctcatcagagaagccttcttttttattcatactaagacaatactttcatgacattcttaacagattcaacagaacggtcaagctgacttctttcttcttctgtcagctcaagctcgatgatctgctcaagtccatttccacctacgattgttggtacacctaggtaaatgccttcgtagccatattcaccttcaaggtaagcaatcgttggcatgacgcgtcgctgatctttaaggatcgcctcaaccatttcgactagtgaagcagcaggagcataatatgcactaccgttacctaataggttgacgatttcgccgccgccttttcttgttctttcaacaattgcatcaattcgctctttaggaatcaatgtttcaagcgggataccgcctgcataagagtaacgaacaagaggaaccatgtcatcgccatgtccgccaagcacaaagcccgtcacgtctttaacagataggtttaattcttgagctacgaacgtacggaaacgtgctgtatcaagaatgcccgattgtccaatgactttttcttttggtaatcctgattctttataaactgcatacgtcattgcatcaacagggtttgttaatacaacaatgatggcttctggagaatatttaacgatttcgcgtgtcacgctgcgcatgattttttcatttgttgacacgagatcgtcacggctcattcccggctttcttgcaattcccgccgtaatgaccacgacatcagaaccggctgtatcttcgtagttagaagttcctgtaatgtttgcatcgaagccttgaacaggacttgcttccagcatatcaagtgctttcccttttgttgggttctcaagctgcgggatatcgactaatacgacgtccgctaattctttttgagccgttagaaatgctgtagttgctccagtaaagcccgctccgataacagatacttttttacgcttgtttgccatttcctttttcccctttaactttaaagtttaagaatcaagacaagtttttgatgagctcgtcagcaaactcagaacatttcacttctgttgcgccatccattaatctagcaaaatcgtaagtgacgacttttgatgcaattgtattttcaacagattgaatcactagatcagctgcttcctgccagccaaggtgctcaagtaaaagcacacctgatagaagaacagaagatgggttcactttatcaagaccagcatatttaggtgctgttccgtgagtcgcttcaaaaatagcgtgtcctgtttcgtagttgatgttcgcacctggtgcgataccaattccaccaacttgtgctgcaagagcatcagagatgtaatctccgtttaagttcattgttgcaacaacatcgaactcagctggacgagttaggatttgttgaaggaaaatatctgcaatgctgtctttgacaataattttgccagcagcttctgcttcactttgcgctttgtttgccgcatcttttccatcttgttctacaatacgatcatattgtgcccatgtaaagaccttgtcgccaaactctttttcagccacttcgtagccccagtttttgaaggcaccttctgtaaatttcatgatgtttcctttgtgaacaagcgtcacagacttacggccttggtcaattgcatattggatagccgctctgacaaggcgagaagttccttcttcagaaactggcttgattccgatacctgatgtttctgggaaacggattttgttaacacctaattcgtttttcaagaagtcaattaacttcttcacttcgtctgatccttttgcatactcgatgccagcatagatatcttctgtattctcacggaagatgaccatatctgtgtcttctggacgtttcacaggagacggtacgcctttgaaccagcgaactggacgtaagcatgtgaatagatcaagctcttgtctaagtgccacgtttaatgaacggattcctccgccgattggtgttgtcagtggtcctttgatcgcgattaagtattcacgaatgtcttcaagtgtttgctcaggaagccattctccagttttattgtaagctttctcaccggcatatacttctttccaagtgatttgcttttctcctttatatgctttttctacagctgcttcaagtactcttgatgctgctttccaaatgtcaggaccgattccgtccccttcgataaacgggatgattggattatttggtacattcaatacgccgccagtaactgtaattttttcgccttgtgacaatgatattacctcccaggttatgtagtgaatatttgaaacttcttggcttgatgtctgcaagcgaagaagtttttcacgtgattcgttttttgttgatatagaggctgattggccttcccgagatcagcccctgcttattctataaacattagtctctttcactgatcggaacaaacgtttgaagatcaggtccaatatagtcagctcttggacggatgagacggttgttgtcatactgctctagaatgtgagcaatccatccagagaatcggctgatcacgaaaattggtgtaaacaagtcatgatcaatcccaagactgtgatatacagatgcagaataaaaatcaacatttggtggaagatttttctctgatgtcacgatttcctctgcgcgaacagacatttcataccatttcggttcgccagtcaggtttgttaaacgctggctcatttcttttagatgctttgcacgcgggtcaccttgacggtatacgcggtggccaaagcccataattttttctttcttctctagcttaccatgaatataggaatctacgttttcaacttcaccaatttctgaaagcatcttcatcacgccttcgttggctccgccatgaagtggtcctttcagcgcaccgatagccgctgttacaccagagtagatatctgatagtgtagcaacacatacacgtgctgtaaatgtcgatgcatttaattcatgatccgcatgtagaatgagtgccttatcaattgcctcaatttctactggtgacggctcttcgccatttagcatatacaagaagtttgcagcatagctgtattcttcttttggctgtacaggctcaagtcccttacgaatacgtgaaaatgcagcgactagtccagaaattttcgcctgtaagcgaatggcttttctgtaattcgcttctttgtccataatctctgattcgttatcaagtaatcctagtaaggataccgctgtacgaatcgcagacattggatgaaccccatccagcgaatacgatttaaagtgctcaatgatttcttgcggaatgtgagcattttcgttgagctgctgttttaactcactcagctcttgctcattcggcagctttaagtgccataacaggtagacaatttcttcgaatgtagctttttcagttaaatcatcgatattgtaccctacataagtaagagtatcatcaataattgagcttacggatgaagttgttgccacaataccttcaagacctcttgttgctgtcatgttcaatctcccctttttaaaaagattccccttcgttgcagaattctcgctttttgaaagcgctatccaatccgaataagacggcaggttcagaaaagaaaatgcttacatttacctatacggttagagcgcttttagcctcatatctcttgtgtgatcaatgagttcaaaattaagcctattcccattataaacaataatcagacatttgttaaatgtttaactataattttttttgatatttttttttccagtcttccatataaggcatggaataaagggattttgcttcttttattatatttaattatgtttttttgcaaaagctcacacaagaaaaaaataaaaaagaaagtggcatgaaccactctcttttcaaccgctgaaaaatttcacagcctgcatcgctaaataagcaattcctgctccgatcagcggaccgacagctacacctttaaataagctgactgccaaaatcgtcccgaacacaagcgctgccgtgatatgcggatcattttcgagtagcacaataccgttttttgcaattaatgctactaatatacccgctccaagtgcaatccaagcgtaagaagatttcacggcttctccaagctgcttaaatccaatatcacctgttgcaatagggacaagcacagcaattgtaataacggtgaccccccaattgatgccttttgattggagaactgggaaaattttttgatccaaaccaatcagcttaatcccaatgagcacagaaaccgctaaaattaatgaattgttttttgcaataagtgcaataacgagtaaaagaaccaaaaataaatttgcttgagtaaacatacgccgccccgtcctttctttttattgcgaccttttcatattactaatctttttgaataaaatgaagtatcggacatgcttgttttttggaggggattgtgtgaatcacacctatatggccatttttctacgaagtttgatgatgatcagcattgctgtatttgcggttgtctttttatatcactcttttccttttctatatcctttttggattgcacttattgtatcctgcctcatccaccctgccgtatgcaaaatagaagagatcaccggaatgccaagaggatttgttgtaatcattgtattactgctctttttattagtagccgccggtttcatcacactcttagtagcagaaatcatttcaggaagtgcttatttggcaaaggttctgcctggtcaccttgatcaaatgattgggattgttgaacggttttttacagataaaatcctgcctttgtaccatgatgtaaccgcccaatttaatacgcttcaagcaggacaaaaggaatcgattttgggacaaatccaagcactgggcgatgaagctgccgccaaaatagggacttttctttcaaaaacactcgagctcatcccagcttttttaggtcttttgcctgatgcagccgcaacccttttgttttctgcactagcaactttttttatcacgaaagattggtttacattaaaaaaatatggttctcgtatctttcccacaaaatggatgcagcatacacgagccattttatctgaaatcaaaaaagccattaccggttttatgaaggcgcagcttttgcttgttgcaatgaccatcggccttgtcatcattggtctgatcatcttaaaagtcgagcacgcccttgtcattgctttatgtattgggtttgtcgatttacttccttatatcgggagcggcactgtttttctgccatggatcatttactctgccatgacaggaaacctttccctcgccatcgggctcggcattttgtatattgtcgtgctcattcaaagacaaatttcagagccaaaagtcttaagcaaatccattgggcttaatcctttagccacacttgtggcgctatttgtcgggttaaaatggctcggtttccttggactcgtcattggccctgcttcccttgtcgtgtggcaagcatttcgtaatgcaggtgttttcagagatatctatcaatacattcggtacggcatgcaaaagtaaaagagaccttcagttcaaggtctctttagcgaataatcgtatagcgactgcgattagacatgttcctgagccaacgttcaaagagcggcttgatttgctttctcgtcatcggaatgagcagcagcgcaccgatgatatctgataagaagccgggaatgagcaggagcagaccaccgattagaatgcaaaaaccatcgacaatcgttacccctggcattttgccatattgtaaatctctttgcactttttgaaatgcttcgattccttgttttcttgcaaaataagcacctagtgcactcgtgagtacgatcatcagcatcgttggcaaaatgccaatgattttacttgatattaaaaataaactgatttccactgcagggaacagaatcaataatagtagcaaatattttttcaaccatatcacctcatggggtatctttcacccgaaagctgttttacttttttagtgtaacataaaaaaagagaggagtcagacaactcccctcgtgtgtatgatttaaaggacgcttgcacggcctttgtagatcgctccgcgtgccggatctactgtaatctcttcgccttcttttagcaatgttgttgcaccatcaagacctacaattactggaatgccaaggctgagtccaacgactgctgcatggcttgttaagccgccttcttcagtgatcagggctgatgctttctctaaagcacccatcatatcacggtctgtacagtttgcgacaagaatcgcaccatcgtacattttttcatctgcttcttttccgctttgtgcaataacaaccggcccaaatgcagatttacggccaattccttgacctttcgcaatgatgtcaccgacaacatagactttcattaagtttgtagtacctgtttcaccaactggcacaccagctgtaatgacgattaaatcgccgtgtctcacgtagcctgtttcaatcgatttctcgactgcattctcaagcatttcatcagtagacgtcgtttttgatccgctctttgcaaatacaccgaatacaagagatagctttcttgcaactgattcgtttgctgtgaccgctacgattggtgcttttggtctatattttgaaatcattctcgctgtatgaccgctttctgtaggtgtcacaatcgctgcaacatcaagcttcatcgctgtatgcgcaacagattgaccgatggcatctgtaatgctgacttctacttcttcgcttctgcgagaaagaatggctttatagttgagtgcatcttctgagcgtgatgcaatgttatgcatcgtttgtacagcttccactggatacgttcctgctgctgtttcaccagaaagcataatcgcatctgtgccatcaaaaatggcatttgccacgtcacttgcttccgcacgagttggacgaggattacgctgcatgctgtcaagcatctgggtcgctgtgatgactggtttgcctaagcgattgcattttttgatcagcattttttgtacaagcggtacttcttctgccgggatctctacaccaagatctccacgcgcaaccatcaaaccgtctgatacctcaaggatttcatcgatgttatcaacaccctcttggttttcaatcttagggatgatttgaatgtcagccgcgttattcttttcgagaagctcacgaatttcaagaacatcagaagctcgtctcacaaaagaagctgcgatgaaatcgacgccttgttcaactccgaacagaatatcattggcatccttttctgtaatacctggcaggttcacacttacacctggtacgttaacaccttttttgtttttgagcgtgcctgtattcatgacctttgtgacgatttctttacggtccatgttcagttctttgacttctaaaccaataagaccatcatctaaaaggattgttgaacccacttctacatcatgaatcaaatcttcatatgtcacactaattttttccgtatttccaacaatgtcttccatacttacgataagatctgcaccagcgactagctcaattgagccgttttcgactgtacgtgtacggatctctggaccttttgtatcaagaaggatcgcaatgtccttgcctaatgttttacctgctttacgaatgttttcaatgcgtgcaccatgctcttcaaaatctccatgagagaagtttagtctggctacattcattcctgcttcaatcaattcagtcagcttttcaatggtttcacttgctggaccgattgtacaaacgatttttgtctttctcattactgttcctcctaaggtcttctcgttttatatagagagctcttgtgaaagtcggtacatgttttgatcgactgtatgttttttatctaagatatctaaaatatcgtggtgaacgaggtcgttgctttgaatacccacacagcgtccgccttttccttcaagaagaagttctactgcatatgctcctaaacggcttgcgagtactcggtcaaacgcacttggagaacctccgcgctgaatatgtcctaagacagatacacgggtttcaaggcttgtctcctcttcaatccgcttaccaaattcaacaccgctgcctacgccttctgcgacgatgatgatactgtgcttcttaccgcgctcgtgccctcttcttaacctcgcgataatttcatccatgtcatagtctgcttctggaatcaaaatagattcggctccgcctgcaagacctgaccaaagagcaatatcaccagcatgtcttcccattacttccactacgtatgtacgttcatgagatgtggctgtatcacgaattttatcaatggcgtcaatgactgtattcagtgctgtatcaaagccaatagtgaaatcagtacctggaatatcgttgtcgattgtacccgggacacctacacatggaaaaccaagctcagttaatttctttgctcccatgaatgaaccgtctccgccgatcacaacaagtccttcaataccgaatttttttaagttttcaatgcctttttcacgaccttcaactgtcttgaattcagggcatcttgccgtgtaaagttttgttcctccacgatgaataatatcgccaactgaacctatttcaagtttctcaattttaccgttaattagacctgaatatccattataaataccgtaaacttcaacattatggtaaatcgctttccttacaactgcgcgcacagctgcattcattcctggggaatccccaccgctcgttaaaactcctatacgcttcatctttttcacctcagagaccatatatgaattaaacataccatttccactgcttgaaaacaatcatgagcaaaacaggatgttttcaatttgtatttctaaaaccgtacttattatacaattaaataaaccgtttttaaacaaaagttaagaaagtatgaaagcaattctttcaaaaacgaggaagatcatcccctctaaatcctaccatatcaaggttttcagacgtttcaaattttatgaaaacaaatgaaaattattttcaaatagcgcttacacgaggaaggttttcatgaaaaaagatgaaaaaaaataaacgtcagccaaaaaggctgtacgtttatttagtttaccccaatatattgattttcaaccgatactttcccgattgctttgtatttttgatatctttgttcgactagttcttcaggtgttagattgagcaaagatgttagtgactgttttaatattttttcaatgtaggctgcttgttgtttcacgtctcggtgtgctccaccttgcacttctttaataacatcatctataatatctaattcttttaggtctggagccgtaattttcattgattctgcagcttttttcgcaagtgatgagtccttccagagcagtgctgctgcaccttcaggtgaaatcactgaatacgttgaattctctagcatgtataggtggtttcctacgcctaagcctagtgcgccgccacttccgccttctccaatgacaatacagacaaccggtacacgaagtcctgccatttcgaataggtttttcgcaattgcttcactttgcccgcgttcttcagctgctttaccaggataagctccttttgtatcaataaagcaaatgatcggacgattaaatttatctgcttgtttcatcaagcgcagcgctttacggtagccttctggatgaggcattccgaaattacggcgcaagttttcttttgtatctttaccgcgctggtggccaatcaccgtgacaggaagccctttaaacgtggcaattcctccaacgatcgcttcatcatcgccataaaaacggtcaccgtgacactcgaaaaagttgtcaaacagctcttgaatgtaatcgagagttgttggacgcatcgcatgacgagcaatctgtactctgtcccacggctttaaatttgtataaatgtctgcttcaagtttgctcagacgtgtttcaagacgctcaatttctgcacttaaatccatttctgagttttgtgtgaactttttcagttcatcaattttcgctcgaagttcaatgacaggtttttcaaattctagttctccagccactctcgttcacctcctgtgctgtgtaacgctaagattcggcctagtgtttctttcatctctgcacgatgaatgacagcatccagctgtccatgctttaacaaaaattcagccgtttggaagtcctctggcaggtcttcacgaattgtttgttctatgattctacgacctgcaaacccaattaaagcacccggttctgcaaagttgtaatcaccaagagacgcgaagctagctgatacaccgccagttgttgggttcgtcatcacagagataatcaaaccttggtcctcgctgaacagttttaatgctgagcttgtttttgccatctgcataagactgaggatcccctcttgcattctcgctccgcctgatgcagtaaagatgataaatggcaccttgtccgcttttgctttctcgatcgcaagtgtgatcttttcaccaacaaccgagcccatgctgcccatacggaatgtggcatccatgacagcgatcacagcacgcttgccttcaatttcaccttgacctgtgacaatggcttcattcaaagatgttttttctctgtctttctcaagcttttcttcgtagcctgggaatccgagcgggttttctgagatcaggtgcccgttaaattcttcaaatgtgccttcgtcaacaaggctgtcaatacgctgttttgcattcatttgcaaatgtctgccgcagttcatgcaaacacgtaaatttttatctagttctttggtgagcattatttttttacattgcggacatttggtcatgatgccttcaggcacatcttgacttgcctgttcagagggtacagatgcatattttttctttttactgaaaatatttttgattgacaaatgactacctccctttttgaagggttttttctttacacgcacatccactattataggacatgtcataactgtaccgaaactattgtactttttttgtcaaacgctgtcatccttcattcaattttttcagtggggaattgatgagaaatgagtatgtgtttggggcgctgagcagttgatataggtgaattgtgaacgtctacaaaaaaatatcattccggatgaaaaaattttcgcgtatgagaggaaatggtgcacgtctttcctccaatttcagaaagaacgtgcacacttttccaattgattattcgccgataatcgttaattttcttgttttttcagcgacttcttctgggtcgacttggattcttgcaacaccagtttccattgctgcttttgctaccgcttttgctaccgctggtgctacacgtgcatcaaatggttcagggatgacgtattcagctgacaatttatcatctgaaacaagagaagcaattgcttctacggctgcaattttcatttcttcgttaatgtgggttgctcgtacatctaatgctccgcggaaaattcctgggaatgccagtacgttgtttacttggttcgggaagtcagaacggccagttcctacaacacttgcgcctgctgcatgtgcatcttctggcatgatctctggattaggattcgccattgcgaagatgacaggatcttttgccattttgccaaccatttcttttgttagagcgcctgctgctgagaccccgatgaaaacgtcagcgccttcaatcacttcttctaatgaaccttctttacggtcttggttcgtgaatttagccacttcatttttcactgcattcataccgttcgggcggccttcataaattgcaccttttgtatcacacatgataatatcacgtacaccgaaatgatatagaagcttgataatcgcaattcccgctgctccagcgccgtttgccaccactttgatagaggacattgattttccagacagtttcagcgcatttacaagtcctgctactgtcacaatcgctgttccgtgctgatcatcatggaacactggaatgtttgtctcttttttcaagcgctcttcgataataaagcagtttggagctgcaatatcttcaaggttgacaccgccaaacgttggctcaagaagctttactgtttcaacgattttgtctacatcgtttgtcgcaagtgcgattgggaaggcatcaacgccagcgaagcttttgaatagtacagcttttccttccattactggaagagaagcttctgcaccaatatttccaagccctaaaacagcgcttccgtctgtgacaacagcgaccatattgcctttcattgtataatcatacactttgcttgtgtcgtcataaatatctttacatggttctgcaacaccaggtgagtaagccaagctcaagtctttcgcatttttcacttgtacttttgattttgattcaagtttgccttgattctctttgtgcatatgtaatgcttcttctcttaatgacatgtgatgaacactccttcaagtggaaaatgatttaatgaattgctaagttgataagcacatactggcagttttaaatacacagaatctttaaaatgataacacaataggtgaatttgtaaaacatattcaggcgatttgtcatcatttaatcacaacgttttgttcaccaagcagctcttttaactggaaaatgacagcatgatctgcatgaactttgtatgcatctggaagtctcactgtctttttttgcttctcataatacaaatagacatctgcttctccactgtgcatcgagatcacccgctttactttctctagcagctcctgcgtatgattttcttctttcacccgaatgtagacagactcttttctttgtgtgcccatctcttcaagcagaacggcttcttgcacgatgatctggctgctgtcatttctgacatctattctgccttcaacataaagcatggcgccctcctcaagtaagggggacagctttctaaattgctctggaaagacgacgccttccatttctcccgtttcatccccaaatgtgacaaatgccatcgattgtccattttttgttcgaatcgatttcacctttgtcaaaagaccacccattgagacctttcgctttatataggaagaaagtctgatgatttccactgcaccattctctcttaagcgatctcggtacgcttgtacaggatgatttgataaatatagtccaagtgcctctttttcaaattgcagaagatcgacaagcggcaattcttctatctctgcatattttggcttaatagagaaggttgtatcccccagaaagtcaagctgatcatctggatttaaaaatgacacgtggtctaatgcaatatctattgatgccaataacgaagcacgatttggataaagctcatccatcgcccctgaaaaaatgagcgcttcaatcgtttttcggttgacactctttgctgatactcttgcgcaaaaatcaaataaatcttcaaacggcttttcctgtcttgccctgtatatatcctttacagctgacactccgacatttttgatcgctcttaagctgtagcggatctcccctttttcaaccgtaaatggaaattcactcttattaatagaaggcttcaacacagatatccctttttcctttgcctcatagaaatattgagcaactttgtcatcatttccaatcacactcgttaaaagtccgcacataaaatataacggataatgcgcttttaagtaagcaagctgaaagccaatcatgctatatgcaacagcatggcttctattaaaaccatagtttgcaaatttgacgattaagtcataaacgtcatttgcaatgttaacaggatactccttttttaggcatccttcaacaaaatggctccgctcttcatcaagaacctttttatccttctttgaaactgctcttcttaatagatctgcctcgccaagctgaaatcctgccatcttcgctgcaatcagcatgatttgctcctgatagacgatgactccatatgtgtcttttaaaatgtcatacaaatcaggatgcgggtaagagaccttgactctgccgtgctttcggtcgataaagagcgggatattctccattggacctggacggtagagggcattgactgccacaatgtcttctaaactagagggcttcaagcgtctcagcacctgacgcattccttgtgattcaagctggaaaatcccagttgtatcccccgctgataacaattcaaatgttttctgatcttcatatgaaatgtcactaaagttaatgtggacgttttcctgtctttcaatctggtttttaatggattcaattaaggttaagtttctaagtcctaagaaatccatctttaaaagtccgagatcttctaaataattcatcgcatactgcgttaaatacacaccatcatggccgtcttgaatcggaacgacctctgtcagaggctcctcgctcagcacaacgccagctgcatgtgtcgaggtatgtcttggcaagccttccacctttaaagcagtttgaaagacttgcctgagctcttcggactgctggagcattgtttttaattcaggagatgcagtgagcgcttctttcagcgtcgttcctggctttgacggaatcagctttgcaagacgatccgctgcctttgaatcaatccccatcacacgtcctacatctcttaaagctgcttttgctgcaagtgttccaaacgtgacaatttgcgccacatgcatgtctccgtatttgtcttttacataagaaatgatttcatctcttctcgtatcagggaaatctatatcaatatcaggcatactgattcgctcaggatttaagaaacgttcaaataacaaaccgtgacggagcggatcaacatccgtaataaacagtacataggcaacaagtgatcctgctgccgatcctcggcccggtcctgtgacaatgccttggtcatgggcatacttcataaaatcccacacaatgagaaaataatcactgaaattcattttttggataatgctcagttcgtactcaagtcttttcacatacgcttcatttgaagcaatctttctttgcttcatcccttccgcacacactttgcgtaaaaactgatctgctgttgattgatcaggggtcggataggatgggagttttgtctgcccaagatttaaatcaacttcacagcggtctgcgatctccaccgttcttgtgagcagctccgtatcctgcgtataccattccttcatttcttcaaaggttctgaaatgcttttctgcttggtcttcctcaacctcaggcagctgctgccctgctttaatcgcctttaaacacgtataggccgttttgtcttccatgttgatgtagtggacatctcctgtcgcaacaagaggaatgtccgcactttttgagacatccctcagtttacctgtaagcgattcgtcttgctgaaatggctgaagtgcgatgtacacatgtccctcaccgaaaatatgtttcaattgtttcgccgcatcatgcgcctcttctatctgatcgtgctgaagcagcgtttcaatgtagccagaaacgcctggtgtgatggcaatgagcccgcggtgatagcttttcagccatttctctttcagtccagcttttgattttgatttcagcacactgctgattttgatcaagttttggtagccttcattgtttttggcaaggagcaccaagggataagcctctgtctcttgttcatctatgaagacagaagctgttaaaccgatgaccggcttgatgccatgttttttacattccttataaaattcaaccgttccatacatcacatggtcatcggtaagagcgagcgccttgtagccaagttcttttgctttgagcacaagctcctttacttttgctgcactgcttaataagctgtatccactgtggacctgaagatgaacataagacatgcttaatccactcctttcgtctaaagtcattctttcattataaaacgcgatgcgatgagaaacaaatgttctttcttttctgtccgttcatacttgtcccgcacgcaccatatattgaatagagtgaggtggacaaaatggatgtgaaggaagcttttattccaaattttatcagttgctattttattgcgcttggagtcattttgggtggtgccattatcggcggtgttggtgcttatttgtctggtcagccgcctttatccattattacgagtcttgccaatcgattaaagatctgggcgcttgtcgcagccatcgggggaacgtttgatgctgtttatagctttgaacgaggcatttttgaagggaacacgcgtgatattttcaagcagattttattaattgtctctgccatgggcggtgcgcaaacgggttatcttattatcacgtggctcacacaggagcatgtgtcatcatgagggtgccggagctttacaaacgtccaggctggcagcgtttttttgcggggatgatgtttggtgcgattgtgagctggctcattttcctctttacatacggaacctttcaggaaaagcaggtgacactgctgagaagccagcagcaccatatggacagtctgaaagaacaaatcacactctatcgggaagatttgcataagttaaatgaggataataagaagcgactgctgatccaaagcgtagatgtccatctcgtcaatcgtgagcagtataaaatcccagagccagacacgctaaaatttgaagatcaggtcaaggaggatatctcagaggttattacaaaggatattgaaagtgtctataaaacaaaggaattattaaaacgcacggtcgaaaacaaagaatataccattcgggaaaaggcataccgcgccaaagtgacagagctgacaatttatacgaagctttcacttgaagtgcgcatttcatttgctgaataaatgatcatgtggaatttttatgaatttctgccctcaatgatcgcttttcccccttaatttttatacactaaaagtagaacgagatctacaatagaaagaggtgaggacaatggaggtttatagctatcgtcaaatggcacgagacaaagcaagccggatcaaggacggcatgtgcgcttatgctgagacagaaatgatggctcatttaattaaaaaagaattaaagcatcaaaatctccaagcctatgaagattcaactgacatcggctgctggtttatccctgtatgcaagtaacccttttctccatgacaaaaaaagagagaggggacttgaagcccccctctctcatgatgatgatttacatacttcttctaaatcacgcaaaatctcatctgccacggcccaatcataaatagatgcaccagctgcaagcgggtggccgccgccatgatattttttcgcaatggtattaatgacgacgcctttcgaacggaatctaacacgaatctgatcattttcttccacaaaaaagacccatgccttaatccctgcaatatttccaagtgttccaacaagctgtgaggcttgctgcgctgtcgtttggaacgattccaaaatatcctgcttaatgaaaacagaagcgactccattctctgacaaagaaatatgttgaaaaatatagccatttaatttcacgacattcagatccgtctcatacaattgattgaaaaggtctgaagatgaaaatggatattcaatcagttctcctgcatatttgagcgtctttttcgtcgtgtttgggaaaaggaagcggcctgtgtctcctacaatgccggcataaatgagttcagccgcctttgtattcagctgatatccttcttctttcccctctaaatacaattcataaatcatttcgctcacagagcttgcctctgtatccacccaaagtaaatcaccataaggatcttcatttggatgatggtcaattttcatcagcttatcgcccattgaatagcgctgatcgtcaattcttgcttgattggctgtatcgcagacaatgacaagggcatctttgtacacgtcatccggtacttcatcaagttcatataaaaatgaaagggatggctccggggttcctgtcgcataaatatttttttctggataggtggcacgcaagatttccgtaaggccgcactgcgatccatacgcatcaggatctggtcttacatgtctatgaatgatgatggtgtcatataatgatatggttctaatcagttcttttttcataaaaactccttcttatccgatactctttttattattaaatcataatctatcctgacggaaaagtgaggaatagacaatttattctagtaagcaagcctatttacgtttaaaatagggttgtaaccacttacaatggaggcttggcacatgcttgttttgattgtgtttattatttgttctgccatgttttatttatactacaaagcaaagaatgtccgtacgaaccgcccagtcgaaaagaaattctggtcggcgaaatccagtatggcacttggctgctttgtcctgctcttcggtgtgaatcaattatttttaaaccgctcgtcactcgcatttgtcattggatttatttttgttgctgtcggtatcggcagtacgtgggctggatataaagcctacaagcattaccttccgctctttttaaaggaaggcgaaaaagatcacgcataataggagagaagggctaaaatgatgtttattttagccctttgtctttttcagcagattatcctctctccatgagctgcaccatcagcatggctttaccgacgatattcgattgatgataaacttccacttccagctttccaaacttgcgtcctacttctaaaatatttggcttgatctgtatcgtggattccatttgaaccggttttaagaagtagacagagagactttcgacaattagctccccttttttatgagactttaagaagcgattggcggattcaattaaaatttgcgtgaacacgccatatgaaatgtttccgagctggtttgtcatttgtggtgtgacctcatattgatacactgcatctgcctttggtttttctgtatcggtctctttaaaccctcttgagacgacatcatccagtttttctccgacctgcggctgcttttgaatcatttgaagcgccttcagcacgtcctgacggctgatcattccaatcagtttcgcataatcatctacaactggcagcacctcaatgccttcccataccatcatttgagcagcagaagcgacagaggttttgccaatgactgtcagtgggtttttcgtcatcaccttttcaatcggtgtggagcggtcatgacctgcgatatcctttgaggtgagaatgccgtgaatcttcatttggtcgtctgcgactggaaagcggccgtggccagtttcataatttttttcataccatttttcaagcttatcctctggtgatagatacaccgttcgttctatcggcgttaaaatatcttccacaagtacaatctctttttttatgagttggtcataaatggcccggttaatgagagctgctacggtaaatgtatcgtagcttgtcgataagatcggcagttcaagctcatctgcgagctgaatgatttcatcatctgttgagaatccgcctgtaacaagtacagccgcccctgcctctaatgcttgtctgtgggcattgatccggtttccgacaatcagcaggtttccagctgccgtatagcgcatcatcgcatcaagctccatcgccccgatgacaaatttgtttaatgttttatgtaagcccgctcgtcccccaagcacctgtccgtcaatcacattgaccacttctgcatatgtcagtttttcaatattttcttttttcttctgttcaattcgaatggtgccgactcgttcaatggtactcacgaaccctttattttcagcatccttaatagcccggtaagccgtgccttcacttactttcatttctttcgcaatacgccggacagaaattttctctccgacatctaatgaatcaatatacgataaaatttgttcatgctttgtcgccaatcccgttcaccctttttgttttcagcgttttcatctaactttcattataagggcaggaggcttttaatagcaatttgtcttttttcagcacgatacatgtaaataaaaaaagccggcatttgagtgccgactttttgctatgttgattaaatctcgatcgattctccgctgtttaacacatgaccgacgccgccatgcaggctgtctgcaaatgcatgtgggtcctgctcaatcggcgggaatgtgctgtaatgaactggcacgacttgcttcgcccgaagccattcggctgcgattcttgcatcgtccggtcccatcgtgaagttatcaccgatcggaaggaatgcaagctcaatatgattcagctcaccgatcagcttcatatctgaaaagagtgcagtgtctccggcatgataaatcgttttgccctctgcagtaaataaaatacctgatggcatgcctgtatacgtaatcgtttttgcatcttcatcaatgatagcagaaccatggaacgcttgagtgagcttcactttgccaaattcaaactcacgtccgcccccaatcgatagcgggtgcgttttcacaccttgccagcttaaataagtggcaagctcgaatggcgcaataacgagcgcatcattgtttttagcgatttcaatggtgtcaccgacgtgatctccatgcccgtgggtcagcaaaatggcatccgctttgacatcttgcggtttgatatctgtgtgcttatttccatttaaaaatggatcaatccaaatatggtatccgtttgtttcaatgtgtacgactgaatgtccgtgatatgtagctttcatgtgagtatatccacctttcgaatttgatctcatttcatctattccctgtataaaaaactgaaaaacttaatgcctgtgaatgacgttaagaccacctgttgcttcaataacagttcctgtaatcagatcagagcggtcatcgcataaaaaggaaatgatgcgcccgatatcttctccagtaccagatctgccaatcggcgtttcgtcatctttcatctggcgtgcttcttctattgtcgattctttcatgtctccaacgattttgcctggacaaaccatattggccgtgatgccgttttcggcttcttctatcgcaatggttttcgtcagtgacgcgagccccacttttgctgctccgaaggctgatctgtgcatccatcccggcgcatggtctgcaccttggaagccatatgtgacaattcggccgaagccttgctttctcatcattgggataaccatacggaacaaatggaacacagcagataggttgccttccatcatttgataccattcatcttcggaataatccgctagtttttttcgttcaaaaatataaggtccagcattgttaatcaaggcatcgattcgcccaaatcgctcggctgccagctcgaccatgttctttaaatcttctttgtttgtcacatcaccttggacaaattgaagcttttcttcatattcctgcaattcttctttcatctgccgtacagcttcatcatcacttcgataattgactgtcacagaataccccatattcagtaaagactcggtgactttcctgccaagtcccttagaacccgctgttattaatgcgtgtcgcacacaatctcctcctaaagcaaaggttgcaagttcacatgtttcttatctttactttactataaacctgcatctggcgcacttatgaaccctttctgttatttctatttagaatgaaaaaatgatgggtgattcatccacttttggatatcccacgagccatgaatatcaagaagcagcgaaacaaaacgatagcattctctcacctcatgaagctggtgaggaagcgggcaaatctcttcatagcccaattgaacatcgtgtgcagcttctttcgtcaaaaggtattccaatgcaataaaatcaaacgcagctggtccaaacacaatatattccgtatccactagactcgtcacttgatcatctttttcaatatattgcgatggatctaaatcaattaaaataagactggctgaatcaggaggattgaggtgatccagcttttgctgcaccatttctccatagcactgaaattcaggctgatcagcataatagcggcttacaagtttggagacagccttttttaaaagagcatgaaatcctctcaaatgtctcgtttctgcaccgtatactgcaccgaaagagtttgttcgatatgaatgaagaagcgctagtttcctcctgtaatctttatagaaatgtgatgagcgcccctcaaaagatgttaaagggatcccttcaatttattccatgacatcatcatgtttccctgccttcttcactttacgaacaactttcggaatatgaaaggaattcgtcagagccagcttttcattgatttgatcgagatattcttgtcctatatgagcatttactccatagattatgtcgatcccatattcaaactcactttctacttttgtcattttaggagatttcacgacatattccgttttgtcttgtaaggagatcagccacacatcattagcccgtccgtcgtactgttctcctaacgtttcaactgatacgatgggctggtcaaacaaagcctgaagcgttctcttcatgaactgctgtcactcctcttcagcttaacactggtatgatttcaacttctccaatgatgatcaatctccttttcccaagacaaaaaaccatccgtatcaacgaatggttttggtcagttacgctaggcaggcttttgctttttctaaagcgagctgaatttgtttaaatccagttccacctgcgctagttcttttttcaacagcaacataaggatcaagaacggtgtaaatgtcttcttcaaaaagagtgctcgcttctgtaaatgtctcaaacggaagatcacttaagtagatgcctttttgaatgcatgtatacacgagcttgccaacgatttcgtgtgcttcacggaatggcatgccttttttcgcaaggtagtctgccacttcggtcgcatttgagaaatcttctttcgttgcttttttcatgacatcttcgttcactgtcattgtttgaatcatgcctgtgaagatttgcaggctgccagcgatggttttcactgtatcaaacatgccttctttatcttcttgcaagtctttgttatacgtaagcggcaagcctttcataatcgtgagaagccccatcaggttgccatacacacggcctgttttcccgcggattaattcagccatatccgggtttttcttctgcggcatcatgctgctgcctgttgcataagtgtcatcaagctcaatgaatttgaattcttgagagcaccataaaatgatttcctcacaaagacgtgagagatgcatcatcacaaggctgctattagacaaaaactctaaaatgaaatcccgatcacttacgccatcaaggctgttttcgtaaatatgatcaaagccaagcagctctgctgtatattcacgatcaattgggaatgtcgttcctgctaacgctccgcatccaagtggagacacgttaattcgcttcaaagaatcttgaaaacgcgctttgtcacgttctagcatccagaaataggcgagcatatgatgcgcaaaggaaataggctgtgcacgctgcaagtgcgtataccctggaaaaatcgtttcaacgtgctgttctgctttttccacaagcactgtttgaaaggaagagatcagttcaatgatatgctctacttggttattcaaatataaatgcatatcggtggcaacctgatcattccggcttctcgctgtgtgcaatttgccgccaagcggaccaatctcatcaatgagcattttttcaaggtttaaatggatgtcctcataatccactgagaattcgagttcatctgcctctgcctttttcatgagcgtattcagtccatctttaatggcagcggcctcctcatcatctaggataccgcatgtattcagcatacttgcatgagcaagggagccggtcagatcttctttgactaattgtttgtcgaaatgaatggacgcgccaaactcatcgacccatttttctggtgttttttgaaatcggcctccccaaagctttttcatgctttaacctgctcctttttattcacgatgctgtttacttttgttggtaagccccaaaggttaataaatcctaccgctgcatcatgatcgaattcatctgcttttgtgtaagttgctagattttcatcataaagtgaatatggtgatttacgtccttcaacaatggcatgacctttaaatagtttcacacgtacaacacctgttacgttctgttgtgtttcttgtaagaaagcatctagtgctcctttaagtggtgagaaccataatccgttgtatattaattcagccattttttgttcaacgattggcttaaagtgtgcaacttccttcactagcgttaagtcttcaagctctttatgcgcttttagaagtgtgacagcacctgggcattcgtacacttcacgagatttaatgccaacaagacggttttcaacgtggtcgattctgccaaccccatgctgaccagcgacttcatttaaatgaagaatgagatcagataaggaatactgaataccatcaatagctgttggttttcctttttcaaacgtgatttcaatgatctcaggtgtgtcaggtgttttttcaagtggcgtcgttaaatcatacgctccttctggcggtgcagcccaaggatcttctaaaatgccgcactcgttacttctgccccaaaggttttggtcgattgaatatgggctgtctaagttaattggaattggaataccgtgcttttgagcatagtcgatttcttcatcacgagaccatttccattcacgcactggtgcaagaacttctaggtctggattcaatgctttaatggagacttcaaaacggacttggtcgtttccttttccagtacatccgtgcgcaaccgctactgcattttctttttctgcgacttccactaattttttcgcaataagcggacgagataatgcagatactagcggatattttccttcatacatcgtgtgtgcttgtaaggcagttagtgcaaattcctctgcgaactcttcttttgcgtcaatcatgtaagactgaaccgctccgacttgaagtgctttttgttgaacgaatgctaagtcttttccctcacctacgtctaggcagcaagctacgacttcgtacccttgctcttgtaaccatttaactgcaacagaggtatcaagacctccggaatatgctaatacgacttttttattttgtgacatgattgaaaagctcctctcacttgttttgattctgtgaatgttttttgcataaaaataagttttaatttataaacatgcatttagtatgtatacactgtaacaaggaaaaattgttttttcaacccctttatgaaaaaaactccgccaaattttcttggcagagtcattttgggctatttttgatccttttcaagctctcgtaagacgtgaggaagctctggaatgatgagttttgtcatggctaaacgaacagctccagtagaacctggtgtggcaaagacggctttttgattgacgatcccagccgcggcacgggacaagatagcggctgaaccaatgtcttctgtatagctcagcatgcggaagatttcgccaaagccaggcagctccttcgagaaaagcggggtgatcgcttcaatggtgacatcccttgcggcaattcctgtgcccccgtttaacaagacggcatctatttttggttcgcctgttccctctagtacagcgtcttggatcgctccaatgtcatcttttacaatatcgtatgcaagaatgagatgtccctgttctttaagcaaatcaatcattagacggccgcttttatctgtttctttcgttcttgtgtcactgaccgtaatgactttcacataaagcctcgctttcgcctcacgtttatgttctgtcacgctcatttttcgcaccgctcctttcatattgcctcacattatagcatgctgatttcaatagaaaaaagcccttttccgctgaggaaaagagcttcaaaaggatgttacgctaaacgcataacgtctcttgcaatcataacttcttcgttcgttggaatcacgattacttttacaggagagtgcgggtagctgatgaatgcttcttcgcctctcatgttgttaagagaaggatcccagtaaacgcccatgaattcaagaccacgaaggacacgtgctctaacttctgaactgttttcaccgattccagctgtgaagatgatcgcatctacgccattcattctcgctgcataagaaccgatgtatttatgaatacggcttgcaaaaatatcaagagctacttctgcacggtcgtttccttcttctgttgcttcttcgatatcacgaagatcacttgatagaccagacacacctaaaagaccactcttcttattcaaagtagaaagtacttcttcagctgtatgtcctgttttctccataataaatggaataagagcagggtcaatgttacctgaacgtgtacccatcgcaacacccgcaagcggcgtgaagcccattgaagtatcaattgatcttccgccttcaactgctgcgatactcgcaccatttccaaggtgacaagagatcaaacgaagttcttcaagaggacggcctaatagctctgatgcacgtcctgttacgaacttatggcttgtcccgtggaatccgtatttacgaataccaaagtttttgtagtagtcgtacggaaggctgtataggtaagactgctctggcattgtttggtggaaagctgtatcgaacacagcaatcgctggtacgtcaggcagaatttgtttgaatgctttaattcctacaacgtttgcagggttgtgcagtggtgctagctctgaaagctgatcaatgtcattaatgacttcatcagttaaaagaacagagtcgctgaatttctctccgccgtgaacaacacggtgtcctacgccatcaatttcattaaagtctttgatgatgttaaattcaattagtttttcaagcagcattttaaccgctactgcatgatctggaatatctgtgacttctgttttcttttctccatctacagaaatcgtgaagatactgttgtccattccgattctttcaacaagaccttttgttaaaacggtttcttctggcatgtcgaacaattggaatttaagagatgagcttcctgcgttgattgcgataattttagacattcttgtcgctccttttactcagttgttatataaggtttcacgttttttccggtgctatattcaacctgtatgacgggtcttttatagtttaacgataagtccgaaaaatatctgactttttcatttaaacattgaaaactttgcatttcaagtgcacctttgaactgttaccgcttacatcgataagtcgttattttctgaataataaaaaagccagacatcactctggctattctttcgtttctttttcttctataaaccattggtctaattttctcatgacacccaccattgattctttttgtgagaaagacggcagattggcaaacagcatccgttttggtgcttcgagcccttcctttttcttttgcatcacaaacaagcttttggcgtgctttttgtctttgaacatggaaaccggcaactgaattaatgcattcatatatgcctgatctttgataaagtcctttaattgcacgctttcttttccttcaaacaaatcgtttggaatgatgaagaacaagaagccgccttcttttgtataacgaaggctttgttcaataaataaataatgcgcaaaggcatgtccttcttttgcctttaattcatagtctgctgcacgttcatcatttggataataaccaactggcagactgcatacagtgacatctactggagagatcaaaagcggctcaaggctgtcttgatggaaaagctcgacttccttctcttccaaattcgcctgtgcccatgcaattttaatgaggacatcatcaatttcagacgcaaagccgcgctttgtttctgcagtcagattatttaagacagcaagcaataagttccctgttcctgctgctggatcaaagacaactagctctttttgaccttctaaaaatttattcaccaaatagctgacaaacagcccgatcgtatctggggtcatctgacgatttggatgggaaatatccttttgtcctttcaatacggcgagctgaaacgctttacgaatctgctcatgatcataagaggcaaaatctgctttctctattacatcctttagtaaaccgtctcgatcatttgcttggaaaaaggcttctcctgcttcagccaatgcctcaatataggaaatactttgtgccttttttaatcgaatagaagctgtatcgagcagctcaaaaatcgtacttacttgatctttctgcaatgcttttctctcctcgctttgttaaaagctatatgttctcattgaaaagagccccagtatgaagccggagctcttgtcgatgctgcttttataacagtgattttgcagcttcaatggctttttcataatttgggtgattcgttgcttcgcttacgtattcagtgtaaaccactttcccattagggtctaatacgaaaactgcacgcgccaataaacgcaattctttcatatatacaccgaatgcttcaccaaatgacatatctttgtgatcagataatgtttcgacattttcaattccgtttgctccgcaccagcgtgcttgtgcaaatggaaggtctgcactaattgtataaatattgaccggacctaaaccggctgcctcttcattgaaacgtcttgtttgtgcgtcacacacacctgtatcaatagaaggaatcactgagatgatcgtcacttttcctgttaaatctgaaagtgaaacttcccctagtgaattcgttaataccgtgaaatctggagcctgctcgcctacttttacttcatttcctacaagcgtgacagaactccctttaaatgtgatcgatgccaaaataattcctcccttatcaaatgtatggttctatcatagtagagaaagcaaaaaactgcaaagcctaatcgtcgcttttgaaaaaaaagttaactgcagcgcagctaactttttaaaggtctatgtcatctagttttcgttctttatgacggttctcccgttcatccttcttaaacatgtgctgaagacgttcaattgcttgaggagcagaatccaatattttatcaagcagatgtgtatgttcatccaaatgaagcattcgaacgccatttgttccgacaattaagaaggcgattggtgtaatagacacacctccgccgcttcctccgccaaatgggagtctcggttcttttcgttcttgatcatcagaacgtttttctttcttttggttcccgttaaattcactaccgccggctgcaaatccaaaaccaacctttgacacagtaagaatgacactgccatcaggggtttcgactggatcgccgatgatcgtattcacatctatcatttcttttaagttttccatcgctgtcttcataagaccttggattggatgatctgccattttcgggttcctccttaaacagatgattcattcttcgttgcttgaagagaggcactttttctcgcctttcttccttttaaccaatggacaagtaaacgaatggctgcaagcatagcatgtccaatacgaaaataagctatacatgtaaactgggtctgtgacacattgtgttgaaaggcaggaataacttcatataccggtttatgcttaaaggtgagatgctcctgcataaaggcgagcaatgctcctttgactgaccacaccccgccggctgctacacctgttaaagcggcgtcatgaaaaccgatccatgttgaccagtgaaacgatacaaccctcatgtgaatgaagaatttacgcatgatccggtttaaatcgacgatctcttttgtgatgcgctccatttgatgaaggatttgcttcatatcacgctttcccacttttttatgtatggattctttttcgtgactaggggttttggcgctcgccatcttcttttcacgtatatcaatcgtttgatcttctggattgatcctcaccatcggaatgtcttttttgagtctgatgattccatataaagtgatgatcttcagtgcaaggtggtcattgtcatttgcatgtgaataatccagtgaaatggtcactttcatgaagatcaataagatcccaaggaacaaaaaagctgcgatccaaacgtaaagcactgtgctcacttcctctataacaaatgatgcttcctctacgattatggctctcattctggattttatacccaatcataaaaaaagagtttgaccggtacccggtcaaactcctctgattatacgtttgcttctgttttttcatattggtgttcatggacgaccaccgtatcggcaaagtaatcatgaaccccttgctttttcggtgtgaacccaacaacagcatagagtacaaaaagcgtattaatatagcgtcccacaatctctctaaagaaaatgacatcccatgccagtttcttctcaggctgaagtgagaccactttgatcccaaacaccatttttccaagcgtttgttgaaagattttcgtcatgatggcgaaataaagcaggaatacaatcgtcgttgtgacagagaatggagaaaaccatcctcctcctttggaccagccaaacagactaaagattggagaaaccgtcaaatggttgacaccccagacgacgagccaatcaagaataaacgcccaaaacctaatccaaaatcctgcaaacgcctgtgcttcaatcattgcacgtttcgcaagagccggattcgattcttcttggcttcggctttcggttacttcatcgaatgtagaatccatctatgatccctcctttattttgaatagagatacatcggtttagacccatttgagccagccagtgtttcttttagattgagaaaatcaatttcacttttaaagagtttgcttgcgctcatattgaagagagagttccagccgaagctttgagaatagctgatcactgtcgctccttttaaccctttttcatttttcttcattgctttgattgcatcttcataatatccaagctcatcaactaatccgttcgattttgcctgtgttccgtcatagacccggccgtcagcaattttcttcacgtcttgttttgacatgccgcgtccttcagagatcactttgacaaatccttcatacgagttatcaaccatgctttgcatgatgtctcgctcatcttttgtcatatcacgatttggtgacatgatgtctttgaattttccgctcttaattgtttcgtatttaatacctaaattatctgccagctttgaataattcaaactttgcatgatcacacctaacgaccctgttaatgtttcaggtgaagcaaagattttcttggctggagttgatacatagtagccgccagacgctgccattgagcccatggagacgtaaatcggcttcttcgcttttttcacttcttctaattttttatgtatttctgcactttcatagacaccgccgccaggagagttaacgcgcagcagtacaccttttactgaagcatcatctttcgctttttctagttccttgaggaatgcacgatgatcataaccttctccgcctaacagacttgatgcgccgccattatcttgaatggttccattaatctcaagaaccgcaatttttccagcaccgcttccatcctctagtaccttctcttctatttcatccccaaattgatagctcattttattgtcattgaagctttcatacaaagcggtcgtgacactaatcacaattgaaaatccgaaaactccaagtgcaatgattaacgctacccatcttttcgcattcatctttttctcctcctttttgtctctcttcattgatacgaatattcacatgaaatgtttcacaggaattgtggtttttttacatttcatttcatcatatgatagcacctctcttaattcacgatcaactttacatcgtctgccaagtaatacgcatgacgaaaaattggcttttttctcctctctctgcacctaataggctagagcttcaccacaacgaaacacctaaaccactctttcatgagaaaacagctattcaattatgctcaaattctgcccttttcaaatcccttacattgactcatttctcaaaatgaatgccattatcacggaggtttttctaatatttttactttcatatgaaaaaagtgtaaaatgtgagcaaggcttcatatgtaagccctttattactttaaatctacttttgacaacgaaggggagaacgtcaatgacagacaatcgtcgcaatgtatttttcttttacaaaaaagatcatgaattggatggacacatttcttctctggagaagctcgctaccgatcaaggctttcaagtcgtcaagcgtgcagaggatgcccatattattgcttcaattggcggagatggcacatttcttcaagcagtccgtaaaacgaacttccgggatgactgcttatatgtaggggtatcaaaaacagagaattcgcatttatactgcgatttttcattagaacattttgataaaatgattgatgccatgaacactgaacagattgaagtgagaaaatatccgatcattgatgtaagcgttgacagtacaaaccagttccattgcttaaacgaactgtcgatccgctcaagcattattaagacatttgtgatcgatgtgtatatagatgatttccactttgaaacatttagaggagacggaatgattatttctactccgactggctcaacagcctacaacaaatcggtaaacggtgcagtggttgacccgatgctcccttgtatgcaagtcacagagctcgcttcgctaaacaacaactcgtaccgtacactcggtgctcctttcatcttaagcagtgaccgcaagctaacactgaaggttgtgcaggacggaaacgaccatccgattatcgggcttgataacgaagcacttggcacaaaacacgtcaaacaaatcgacatcggcctttcaggaaaagtcattaaaacggtgaaattaaaagacaactcctactgggaaaaagtaaaacgcagattcctttaatcaaaaagctcctttatggggcttttgttttcttttcagcgtgatagaaaacctttgaagtctaggaagagtgagcaccggaacggagcgaatttgacattcgtgagtaccggagcgcaaatctgacaccgaatgcgagggtttgtctacacgctgaaagctcctttacgggggtttttttcgtgtcttttcattcacggtcatgattatggtatgatgtcacaagtatgaatgtacgaaaaggagaacacgatgacattacaacaatttgatcaatatccattaagcgatgatttaaaacaagcgctaaaagcacttcacttccatacacctacacctgttcagcacgagacattatccgttgctttttcaaagcaggatctgatcgtcaaatctcaaacaggcagcggcaagacggcagcctatggtttgccgatttgtgaaatggtcgattgggctgaaaataaacctcaagccctcatcctcgttccaacgcgagaactcgccatgcaggtcaaacaggatctcacaagccttggacgattgaaacgaattaaagccgcagccatttatggaaaagccccttttcaagctcaaaaagtagagcttgcacaaaaaaaccacattgtgtgcggaacaccgggacgagtcttggatcaccttgagaaaggtactctttccttagaaaaccttaaattttttgtattagatgaagcggatgaaatgctgaacatggggtttattgatcaagtctcttctattattcagtatctgccgccaaagcgcatgtcaatgctgttttcagcgaccatgtctgatgagatgaagaaattaagtgaacagtttttacattcaccaaaagtaattgaaattgcacgggaagaaacgtctgtaccacaaatcactcacaccgtgattgaaacggaggaagaagcgaaattctctcttcttcagcgtacgatcgtgattgaaaatccagatagctgcattattttctgtaatacacaggaccgagtgaacgaactcacaatgaagctggatgaatgggatgtgccttgtgacaaaattcatggaggcatgagacaagaagaccgcttcgctgtcatggatgaattcaaaaacggtgagttccgttatttgatcgcaaccgatatagcagcccggggtattgatgtcagtgatatgacacatgtgattcattatgaccttccctatgaaaaagagcgctatattcaccgaacaggaagaacgggcagagcgggaaaaagcggaaaaaccattgcgtttatgacgagaaatgcaaagcctctgattgatgaattaaaagaggaagcaggtattgatttcaagacgcagccatacccaacaaaggaagacgcagagcagcatgtagaaagctttgaagaaaagattgaaacgccgattcaaaaggaaaataaacaggcaggcgttgaaaaggatattatgaagctttattttaacggcgggaagaaaaagaagctgcgggctgttgatttcgttgggaccattgccaaaatagaaggcgttgcctttgatgacattgggattattaccattcaagatacgaaaacatacgtcgatattttaaacggcaaaggccctcttgtgctgaacgccatgcgccacacaaccattaaaggcaagcagttaaaagttcatgaagcacgtcaataaaaagtgaaggctaagcgcctttacttttttatttaaaataaaataagcttacaacccttgaaccatcagcctttcctgcgtccaacatgacaaatgtcatattgaatacatgatgggtgctactatgagcatgacacctttccatctatactttgaagtagaaagaaacggaaaggacttgaacgttcatgacgacttcaacaaacacacagcagcaagccactttaagaaaacaagttggccaattctctggtgctaattcaaaaaaaagtatcactcaactctttaatacattcattccatttttggggctttggtttcttgcctattatagcctgaacatctcctaccttttaaccctcttctttgcggttattgcagctggttttttagtacgtgtctttattatttttcacgactgctgccatcaatcctttttcaaacagaagccactgaatcacctgttcggttttgtaacgggcgtactcacccttttcccttatcttcaatggcaaagagatcattcaattcaccatgccacaagcagtaatctagacaaacgaggtactggcgacatttggctcctgacagtcaaagaatatcaagaagcatcagcttggacgaaattccgctacagattttatcgtaatccttttgtgatgtttattttaggaccgatctttgtttttctcttaaaaaaccgtttcaacgtcaaaaatgctcgtaaaaaagagcgctggaacacgtatttcacaaacgtgagcatcattgcgctagcagctgcaacgtgtctactttttggctggcaggagttcctgcttgtccaaggtccaatcttcctgatctcaggatcaatcggtgtatggctgttttatgtgcagcatacatttgaggattcttactttgaagaagatgaacattggaattatgtgcaggcagctgtagaaggcagttctttttacaaattgccaaagcttcttcagtggttaacaggcaatatcggctatcaccatgtccaccatttaagcccgagggtaccaaattatcacttggagcatgcacatgatcatagtgagccgcttcaaaatgttccaaccatcactttaaaaacaagtatcgaatcaatgaaatttagactttgggatgaagaaacgaaagcattcgttacctttaaagaagcacggcaatctaagaagatgcccgcacctgtcattaaaggagacattctgaagaaaaatgcataattggtgcaagctctttcttacactagaaggagcttgttgccatttacaggatgcaaccatatgttgaatttgataaagtaaggaaaagaacgaaaacggaaaaggtgacacacggatgaaaaaacagtttaaaattcaaaaattgcatgggatttctccctatatatgggccatttttttcatcctgcccttctattttattttaaagacgcctacgactttaggtattgtcattggcattattttgaatgtggtttttttcggagtgtatcgttttgcctttgtcgcaaaaggatgggctttatatgtactcggtcttttattgattgcgatttctacaggctatgtgatgctctacagctatatttatttcgctttttgcatcgcctatttcaatgggcacattaaaagaaaagtccctttttatattttatactatattcatctagggagcgccgccgtagcagtgaactttagcttgattttaaaaaagggatggtttctcacacaaattccttttgttgtgatcacactcattagtgccattctccttcctctcagcattcgaagccgaaaagaacgtgaacgccttgaagagaaattagaaaatgccaatgaacggatcgccgatcttgtaaagcttgaagaaaggcagcgcatcgcacgtgatctgcatgacacccttggacaaaagctttctctcattggcttaaaaagtgatcttgcccgtaaactcgtctataaagatcctgaacaagctcgcgccgaactgaaaagcgtccagcagacagccagaacgtctcttaatgaagtccgcaagattgtttcttccatgaaaggcattcgaatcaaagatgaactgtcgaacatcgagcaaattctcgaagcagcggggattgaattgatttatgatgaaaaggaagcgccaaaacgcatctctcttcttaacgaaaacattgtgagcatgtgcatcaaagaggccgtgacaaatgtcgtcaaacatagtgatgcgaccgtttgcaaaatcaccattcatcaaaaatcaaaggaagctatcatcacagtcgaggatgacgggacatttaaaggcgatgatccactctctccaatgaaggggcatggccttttaggaattagagaaagattggaatttgcaaatgggcgcctgcgtattgagacaaaggacggaacaaagctgatcatgagcattccaaatgattcagcagcaaaagacaaggaggggatgaaatgatcaacatttttatcgcagaagatcagcaaatgctgctcggtgcgctcggttcacttcttgatttagaagacgatatgacggttgttggaaaaggtacgaacggccaggacgccatcgattttgccaaaaaacaccctgttgatatttgcttaatggatattgaaatgccaggaaaaacgggacttgatgcagcggaagagctcaaaggaacagatgtaaaaatcatcattttaacgacctttgcccgctctggttatttccaaagggcgctcaaagctggcgtcagcggctatatgctgaaagatagtccaagtgaagatctggcaagtgccattcgcagtgtgatgaaagggaaaaaggtgtacgcccctgaattaatggaagacttatatagtgacgaaaaccctttaacagatcgagagaaatccgtacttgaactcgtcgccgacggcaaaaacacaaaagaaattgctaaggagctcagcattaaaagcggcactgtccgaaactacatttccattattttagataagctagaagtgaaaaaccgcattgaagccattacacgctcaaaagaaaaaggctggtttaaataagaaaaaagatcaggacacatgctgccttgatctttttttctaccaaaaatctcctctcctattttttatcaccaacgatcaaaatgtaattgacaacagaccgcacttctatgatatgatatccaagtgataataattatcattatcactcatacaatcaaatacccggcttatgtgccgatttcaaaggagtctacattcatgaagaaaatattgttccctctgatgctcatctttgtacttgcattgagcgcatgtggcaatagcagcagctcttcctcaaataaaggaaatcaatcaacatcatcagacaaaattacatatgaatctgaaaatggccctgtgaagctgccagcgcacccaaaacgtgtcgttgtacttggttcctacacaggtaatgtcatgtcacttggtgtgaacctggtcggcgtcgactcttggtcaaaaaagaaccctcgcttccaaaaggaattaaaaaatgtggaagaagtgtcggatgcgaatgtcgaaaaaatcatgaagcttaagcctgatgtcatcattggcttaagcaatacaaaaaatgtagaaaaacttaaaaaaatcgcaccaaccgtcttgtttacgtataacaaagtcgattaccttcagcagcatattgaaattggaaaagtattaaacaaagaaaaagaagccaaagcatgggtaaaagattttaaagaacgcacagctgaagcaggaaaagaaattaaagcaaaaatcggtaaggatgcgacagtttctgtatttgaaagcggcacaaaagatctttacgtgtttggagatgcatggggccgcggcacagaaattctctaccaagcaatgaaactaaaaatgcctgaaaaagtgaaagaaaaagcattaaaagctggatactatgccgtttcacaggaggtcattcctgaatttgctggagactatatgatcattagtaaaaacagcgaaatggacaattcctatcaaaacagtgaaatctacaagtccatcccagctgtgaaaaaacatcgtgtgtatgaggcaaatgcagaagaattctattttaatgacccactcacactcgagtatcaactatcattctttaaaaagcacttcttaggtaaataaactgaagcaagggagcccttcccttgcttttttcttgtctgcttctagcggcagcgtcttttttccgctacaattacatacaagcgaatacaaaaagtgtggtgctggttttgtttaaaattttactgattgaggacgatacaaccctcttccaagaaatcaaagaacgtctagtgaactggtcctatgatgtatatgggattcacgattttcaacaggtgatgctggaattcacttctgttcagcctgatctcgtcattattgatatacagcttccaaaatacgatggttttcactggtgccggatgattcggcatcattcaaatgtaccgatcatcttcctctcctctcgtgaccatcctgctgatatggtcatgtcaatgcagctcggtgccgatgattttgtacaaaagccctttcactttgacgtgctcattgccaaaatcagtgccgttcttcgcagagtgcatgattataatgcagaacctgccagcttaaaggtatggtgcggcgctacgattgatttagaaaaaaacaccgtgacaaatgatcacggtgaagtggaattaacgaaaaatgaactgtttattctcaaggaattgattcagcataaaaatcatattgtcagccgggaatcactcattcaagcattgtgggaggatgaaaggtttgtcagtgacaatacacttactgtgaacgtcaatcgccttagaaaaaaactagatgagatctcccttggtacctacattgagacaaaagtaggccaaggttatcttgcaaaagaaaaggatgatcaatgatgctgcaagcatttttaaaagaacgaagaagctggattctgttctttcttagtttgcagctcctcattctgtttgttgcttttttggatacgaccattccaatggcgtctcttttttatattgtattattatctacgtttttcatgagcgtctttctctttttccgataccgtaaagaaacggcgtattatgagcgtctgaaagaatgggatgatcatattgatcatcaaatgcggcttactccatcttccccatttgagcagcttgtacatgatgcgacgtctgagcaaattgaccgctaccggaaaatggcggtagaacaacaaatcgcccttgaagaagagaaagatgaattgctctcatggatacatgaagtgaaaacacctctcacagcgatgcacttaatgattgaccgcttaacagagcagccgctgaaatcgaatatgacgtacgaatggctcagaattcatttattactcgatgcccagctgcaccgaagcagaatacgtcatatcgaaaatgatttatttattgaacagctggacctgcaaagcatcctagcaaaggaaatcaaagcgctccaatcatggtgcatgcaaaaagggatagggtttgaactcacgctagaagcacgtcacgtattaagtgatgcaaaatggctatcctttatgatcagacaggtgcttacaaatgcagtcaagtatagtcattcgtctgatattgccattgaaagcaagcaaatcaatgagcaagtgatgctgacgatcacagatcaaggcagaggaatagatccaagagacctgtctcgtatttttgaaaaaggctttacctcaacgagacatcacaatgacaccgcctcaacaggaatggggctttatttaacgaaaaaaggagcagacgctcttcatatcaaaatcgaggtcaactccacgatagatcaaggcacaaccttcaccttcatctttccgaaaaagaatgattttgtgcatattgcgagcatgtgacaacaatgtcacatgctcgtctgttttgttcgccaaatcgaaggaagtgcggcgggcttctttttatactagagatatcaattaaatagaaaaggggatcgacaaatgaacattttagaagctcgcaaaatatataaaagctacggaaataaattcaacaaacaagaggtgctgagtggcattgatttgaccattgaagctggagaattcgtcagcattatggggccatcgggctcggggaaaacaactcttttgaacgtattgtcctctattgatcatgtgtccagcggatccattcgtatcgcagatgctgagatgacacaaatgaaggatcagcaactcgcagaatttagaaaaaagcagcttggctttgtttttcaggattataacttacttgatacactcacggtcaaagagaacatcctcttgccattatccatctccaaaacgccgaaaaaagaagcttttgaacgttttcaacagcttgctgaggacatgggcatctatgaactaagagacaaatatccaaatgaactctcaggtggacaaaagcagcggacatcagcggttcgtgccttcattcatgagcctagtcttattttcgcagatgaacctaccggagcgcttgattcaaaatctgcatctgatttactcaataagctgcaagatttcaatcgaaaacgaaaagcgaccattgtcatggtgacacatgatcctgtggcagcgagctattcaagacgcgtcatttttatcaaggacggacagatttatactcagttgaataaaggtgctttagagagaaagatgtttttcgaggatattatgaaaacgcaaggtgttttaggcggtgtgaagcatgaacattaatcagctcatcctccgtaacttgaagaaaaatttaaaaaattactatttatatgtgtttgctctcgtgtttagtgtggcgctctacttttcttttgtcaccttgcagtattcaccagcacttgatgatgtaaaagggtccattaagggcggtgcatcgatcaaagccgcttcggtactgctcatcgccattgttgggatcttcctgttatatgcgaacagcatttttattaaacgcagagggagagaaataggcctccttcagctcattggcatgacgaaacaaaaaattgccaaactgcttaatgcagaaaattttattctatacgtattctccatggctgttggcatcatagctggatttatcggttcaaaactcatgctgatggtgctatttaaagtaaccggcgtcagcgccatcgccaacctgcacttttcaggcatggcccttttgcagacactgatcgtctttttcatcatctatggattaatcatgttaagaaatagatggtttattaacagacagaccattttatctttgtttagaactacgtcttctacagagcagcgtgtgaaaaaaatctctgtgtttgaaattatcattggggttctcggtattgtcttgatcagctcaggctattatatttcttctcagctttttaccggctcatatacgtccatgcttgagttattgttagccatgatctatattctagcctctgtcattattggtacctttcttttctataaaggctctgtttcattcattgccaatatcgtacgtaaaagaaaaaatggctatctcgccattcatgaagttctgtctctttcatctattatgttccggttaaaatcaaatgcactgcttttaacgattattacaacggtatctgcacttgccatcgggttgttatctttaagctacatttcctattactcagcagaaaaaaccgctgaacaacagattccatcccatttcgtcatgggctcagagaaagaagccgataccttcactcgtgcactttctgacaaacatattgcgtatgaaacaaagcagttcaaggtcattcaagcgaagtttgacgcaaagaagatcatggattcagagataaaaaatatgaataatgatccaggcgtcttaactctacctgtgatcagtgagaaaaacgcaccaaatattcaggtgaaaagcaacgaagtcatcttaagcggctacagtgatttattgaagaaattcatgccgattcaaagctcaggtgatgtgaaactacttatcaagaaaccccttgatttaaaggtcattgatatgaagaaagattacctcatctcttacaaattcacttttggtggtctgcctgttgccgtcgtcagtcaaagtgtctttgagcagcttgaccagcagaaagatcctaagctgcaacttgagaataaccaatataatgcggtcaatataaaagatgatcaaaatcttgaacaggccaatgatatgtttacatctttaaaactaagtgacaacagcatgtctcaattagcttcagctcagcagcaaaagcaaacaataggactgatgatgtttgtggttggatttctaggtctaagcttccttgtcacatcaggctgtattttatacttcaaacagatgaatgaaagtgaagaagaacaaagctcttacacgatcttacgtaagcttggctttacagagaaagacctattaaaaggcatccggctcaaacagctgtttaactttgggattccgctcatcattggattgctgcacagctactttgctgtacagtcaggctggtttttattcggcggtgaattgtggactccaatgctcatcgtcatgtcgatttatacggttttatattctatctttggattcctgtctgtccaatattataaaaaggtcattaaagaatccttgtaatctaatccccataggcagctgcctatggggattgtttgtttatgatggagttgattcaaacttgtgcgatagaatatgatctcttgccgcataagctttccgtttgacctcttctaggttcacaccgacaagttttccgtttcgtttcactgcttttccagccacataaacagaatcaacatttgaagggtgtgccgtttggacaaccgctccagccggatctgacatcggcagaagattcatgcttgtccggtcgattaggatgaaatcagcttcttttccaggtgtgagcgagccaattttatgatcaagctgtaatgcacgagccccattgatcgtcgcagcctcaagcatttgttgagcagaaattccaagttcaggccccggcatgattccctccatcagcaatgcttgattttggagcgcgcgctctgcctgaagtccgaatttcatttgagcaaacaaatctccgcctgtcgctgtaactacgtctacaccgagcgttggaagaacaccttgttcgatcgcaagtcctgtcacaggataaccgtgacccatcatcatttcaatttcaggtgtaatggatatggagcttccgctgtctgccagcatcttcatttgatctgcatcgattgcattgatatgcaccatgttgaggtcaggtccaagtaaccctgctttgtgaagccgctcaatcgaacgatcctccgctccccagttcccaaagccaatatgcatactgcatagagcatctagagaccgtgctgtctcaatttcaaatactgaagtttcccatgaagaaaactctggtccacgaatcgcaagccccattgtcaaaagctgatctgatgattgaaaatgtgcttttttcacgcgtgctgcatcctccatattggtgagcgtgctctccctatcccaatactcagcatctccagaggtaccgaaagcaaaaacagctcgaatgcccgcatcctttaaccctccgatgagctcttctgtatgatccattgaattgatcatcgtccagtctaaacaggtggtcactcctgcatctaatgcctctaatgcccctaaataatttgcgattcgatcatcggatgggcgtctcatcgcaccatagtttccgtaatagattttgctcaaatatgtctgcaaagaccaatctgtgcctatgcctctaatgaccgactgccacacatgacgatgtgtatccacaagccctggcatgattaccatatcggacgcatcgacaatgtcagcatcagttgcttcaatgaaaggcccaacctctaaaatgtgtgtcccttcaattaataaatctcctttttctaaaaaacctaaagttggatcaagtgttaaaagcgccgcatgtttaaacaatgttttcttcatccatatcccccttttcaaatgacgaggaagagttctcccaccctcactgtcattttaaaacataaaaggatccaattagaagaaaagtgacttcactaactgttttatgagctgatttttctgaaatagttatagattcgttttaatttgacgtcatgttttccttttgggctttccatcatgccgaactcaaagaacttcacaggtttgattccgacatattgtaagagggctcgtttcattaacaccttgtgtgcattttgcaaaaagaagagagggtagttggttggcccttgcatcgtcgatacacaaacagcactttttccttttaacagtccttctggaagcagcccgcctgtttgacgataagcaaaattcgcagcaaacatgcggtcaataaagccaagcagcatggctggcggtcttccccaccaaataggatatacgaacacgattttgtccgcccatttgatcttctcctgatacacccgaatgtcagggtccttatgcatgtcacgcctttttttctctttattaaaaatcagcacagggtcaaattcttctttgtataaatcgatgattttcacttcatgaactagtggattttcttcactgcctttcatgatttcttttaagaaagcaccatttaaactattgtgatgggggtgagtataaataatgagtacattcatgtatgagctccttttgttatcatttgataactaaatgatatacccccattaaatagttgtcaaatgataattgttttttgataataattttggtatgttacgtaggaggtgataaacatgcaacatccccatttcttcaaggaattcgtagcatttgcttctactttttcagaactaaaacatgacctaatgaacaaagtcaaaccagctaacttaacgaccttacaatacttgatactagagcagctagctgtcagcgagccgcttacgccaagtgaaattgccgactgtcagcacatgtctcttccgaatgtcagcagagaactgaaaaaactgcacgagaaacaattcattgataaagaagaagaccgtgatgacaaacgaaaacacgtcattatgctttctgacaaaggccgtgactgtatgaacaaagccttccagcatatcgaaggggtgctattagacagcctatcttcctcggatatagaacaaatggatgatatcgtacaagctctccgccttttaaatcaaacgattttcaaaaaagaacctaaaaaagcatgagcatatcgctcatgcaaagaaaatacaaaaaagcgcaggcctctcatctgcccaaacgctcctctcttttttctctatgtacctttatacaatcaattgatacgcaatgtataacgcgacaagccagatcatgaccgctgaagctttattgatacggttcatccacttgccgtttgtatctaacttccctagcatcttccctaaaagagcgagcccaataaaccataaccaggacacgatgatacaagcgagtgtaaatgcccatttttctgccccgctatattgaagcgaatttgtgccaatcacgccaatggtatcaagaatggttggggatttaaaagtgaaactgaacaggcaaagagaatttgttttctcgcaggcatgaattcctgcttctctttagcatctgttgatgagcttgtgttccatacggaccatcccatataaactaaaaaacaaaatccaatgagataaagacacatttgtagcataggaatggtgaacaccacaacagaaaccccaatgacagctaacgcaattaaattaaaagtgtgtcacaaagagcagcagtgatcacgacaggtaaagcctgatataatcgcggctgaagggctccttgctgaaacacaaatacattttgtgcgcccaatggtaaaatgaggccaaaggcaagcacaattccatgaatgatggcaatgaacatcttctaacattctccttttccagaaactcctacacattttaacataaaacatcttgatcgcttccagcagatttgattttccataaaaaaagcgctggatgctttcatccaaacgcttttcatttattcatcatgatccttttcgtgcaagctctctttctctcagctcgacacgacggattttcgctgacggtgtttttggcagttcgtcaatgaattcaatttctcttgggtatttgtaaggtgctgttgtgtttttcacatgtgtttgcagctctttgatcagctcatcactttgtgctgattcatcacgcaggacaacatatgccttcacgatggatcctctgatttcatctggactcgccacaaccgcacattctttaactgctgggtgtttaatcagtgcatcttctacttcaaacggcccaatggtatagcctgagctgacgatgatatcatctctgcggctttcaaaccaaaagtacccatcttcatcctttttcgcacggtcaccggtaataaagtaattcccgcggcgctgcgtctttgtacgctcttcatctttgtagtattccttaaataaagccggcgtttcgagatggaccgcaatgtcaccaacttctccaggagcgcacacggtgccgtcctcatcaatgatctcgacttcgttgccaggtgtgggtttccccatactgccaggcttgatgtccattccttttagcacccctacgagcagtgtgctttctgtttggccatagccgtctcgtacttctatatcgaaatgctttttgaatgtatcaatgacttcacggttgagcggctctcccgcagacacggcactatgtagctttggaagctcgtactgacttaagtcatctactttcgccataaatcggtattctgtcggcgtacagcataggacattgatttcatttttttgaagcagctctaagtacgtatttggattgaacttccctccgtatacaaagccttctgccccgcttcctaacacagataagagagggctccatacccatttttgccagcctggtcctgctgtcgcccatactttatccccttcactaatggagagccatgctttggcagcagtgcgtaaatgtgcatatgcccagccatgtgtatgaacaaccccttttgggttgcctgttgtaccagatgtataggataagaacgccatatctgtacgtgttgtcggagccatttgcagctcgcttgattgctcttccttttgcgcgagaatgtttgtccatccatgatcgttttcaccgattgagaatgttttaaaatcgtttggctggttggttccgtcgaacgattgaatgaatgaagagtaaacgatcgctccctttgcttcagcatgttcaattcggtaatctaagtcttttgcacgcagcatttctgaacaaggaatgacgaccattcctgttttcaagatcgctaaataaatgctgtatgcgtctagcatgcgcggcaccatcacaatgattttatcgccttttttaaagcctgcatttaataatacatgaccaattttatttgcttcttccactaaagatgcatacgtcacatgtgcttcgtagccatttccatcctgccagtgcagggcctttttctccttgtcatgactgaacgcttcaatctcactgactaagttatattgttctggtgcaattaagtcttctcttttcatggtacagctccttttagcctctttctatgaaacgaaacatgtttcaatttacctattctaacactcataactgaaaaatgcttgaattaggacctactcctagtattatgccataattttttcattccgtcttcttttttgtaaatattcaaactatttttatgtacaaatagaaaagagcgggaatgatcccgctcctaagccatagctttttaattgtgtgtcttagaaagatccgccacccatatgttgttgagcgtaagatacaagacgcttagtgatttctccaccaactgatccgttagcacgagaagttgtttctgcaccaaggtttacaccgaattcagaagcgatttcgtacttcatttggtcgattgcttgtgcagcgcctggtactagtaattggttagaactgctttgtctgttttgttgagccatgtgttctcacctccttgtgaatatagaatgtgtagaaacacatgacttcatgcgattgtttttatggtaattattatgaaatttttattttagaataaatcagcgaattcgtctgccgctttcttctcttttgtgacgatgatcgtttcgatttgctccactgcctcatcgagcattggctcgaaatcagcaaagctttcgtatcgttctactttctcaagctttggttttgttttaggagatggcggcgtaaagattgtgcagcagtcctcaaaaggctgaatgcttgtctcgtatgtgccaattcgtctcgcttcatcaataatgtcattcttatcaaccgcaatgagcgggcgaatgattggtgtattggttacatggttaatggcatacatgctttcaagtgtttgacttgcgacttgtccaaggctttcacccgtaataatcgcaagagcatcacgcttctctcttattttatctgcaattttcagcatcattcttcttgttgatgtcatcgtatagttttcaggtacctgtttgtggatcagctcttgaatttttgtaaaagggacaatgtgaagcttcacttcgcctccatatgcagctaagcattctgtcagatcaatgaccttttgcttggcacgttcacttgtatacgggggactaaagaaatggacagcctcaatttgaataccgcgtttcatcgcttgatagccggcaactgggctgtcaaagccgcctgaaagcatgagcatcgctcttccacttgaaccaaccggcagtccgcctgcacctttgacatctttgaatgtaatatatgtcgcatgttctcttatttcaatacgcaaatgcacatccggctgtttgacattgaccgttaagttttctgtattcctcagcacatgtccgccaatttcgcggttcatttcatttgaatcaagttcaaattgtttataagagcgtttcgttgagaccttaaatgtatttccttcttcatatacttcctgtacagctgtgagtgccgcttctttgatggcatcgagatttgtctcacatttcaccgcaagactaaagctttgaatgccaaatacacctttaagctgttctgaaatcggttcagggtcttctccgttcagcataatcgtaatgcggtctctatcagatgcatactttaatgctgcaaagtctttcaatacaaaccggatatgctgccttagtttttcaataaatttctttctatttttcccttttgttgaaatttcaccaaaacggactaaaatatgatcatatttcatgttgttatctcattccttttaattttttcacactttgtgcgatcgatgtgatgatttgcggtgctagctctggtccttgtccatacgtcaagctgattctcatactgctttttgccacttcttccggtttccccatcgctaggagaacttggcttggctcctttttcttagctgagcaggcagaggttgtcgaaacatatatcccttctttttcaagcatatggagaaggacctcgatctgaatacctggcactgaaaaattcacaatatgcggcgcactttgcgtcagcggtgtgttgatgacaataccttctatttctccaagctgctttagcagctgcgtttttaagttgagcatttcatcatgatgttttttcagcagctcgaatgattgtttcatggcttttgctaggctgacagcaccagcagggttttcagtacctgaacgcaggcctaattcctgctctcctcctgtgataaaaggggcaagcactacacctttttttaaaaagagcgctccagtgccttttaagccatgaattttatgaccagatatcgtcaaaagatccacatccagttgtttatcaagtgctactctgcacatcccctgcaccccatcgacatgaaaaagggcattttcagcatgctcacgaatcatgccagcagcttctacaatcggctggatggcacccgtttcgttattaacgtgcatcatacttacaagaactgtatcagggcgaagcacctcttttaaatgattcatatctgcatgaccatgctcatttacttgaatataggagatatcaaaaccaaataaagccttcagctgttcaaacgattcgatgacagagggatgttcaatggctgttgtcacaatatgtttcccccggttcattttggcgagagctgctcctttaatggcaatgttgttcgcttctgttgcaccagaagtaaagataatctcatattgtttcaagcctgtatagtgaagcatttgttttctcgtttcatttagcagccggcttgcatcaattcctagctgatgaagcgatgacggattaccaaaaaaacgttcactcacttgctgatatacttgtaaaacctctgggtaaggcttggttgttgcactattatcaagatagatcatattgtaactccttacaaaaaacttaaaaaataaatgcatttatatgttaccataatgaagtcagacatagaattttctgaaaatggcagttgacaacttttcattttcactatatcatccatagtgccattggcacataaacattttaattgtcagaatattttaatttggcacactacactgattaaggaggaactattttgaaaaatagtttaagtataaaggagacgctagccattggcctaatgctttttgcattattctttggcgcaggaaatatgattttcccacctgttcttggacaatatgcgggtgagaatgtatggcttgccatcggtggatttttactcacaggagtaggtcttccgcttcttggagtgattgcagtcgcccttacaggtaccggtgcaaaaggccttgcagataaagcacacccaaaattcgggaccatctttaccgttattttgtatttatctatcgggccattttttgctattccacgaactggtacggtttcgtatgagataggattagctccatttctttcaggtgcccaatccacttcatgggtaccactattcatctttactgtagtgtttttcactatttcatacttgcttgctttaaatccttcaaagctggttgatcgaattggtaaaattttgacaccgatcttattaactgttattgctattattgtcattaaagccattgctaccccaatgggaatgatcggtgctcctgatgcaacctataaagcaaacccgctctttactggatttttagaaggctataaaaccatggatgctcttgcttctatcgtatttggaatcgtcgtggtgacagctgttaaggacagaggcatcacagagcgtaaatctcttgcagcagcttgtattaaagcaggactcgtggcagctgttgggctggcactcgtatacatttcacttgcttatgtgggtgcttcaagtcccgatgcgacgggaatggttggagcaaatgatggcggcaaactgctttcactttctgcaaactttttattcggttctgctggtaacattgttcttggcgcagccattttattcgcttgtttaacgactagtgttggacttatttcatcttgtggagaatatttttcaaagctcttccctagcctgtcttatcgcacagtcgttctgatcgtatctttatttagtacactggttgcaaaccttggactggcacaaattatctctctatctgttccagttcttgtatcgatctatccactagccattgtcattattttattgtcattccttgatcgctggattaacggaagaagactcatttatatcgtatctcttatctttactggtttcttcgccatcattgatggattattagctgccgaagttaatctaggcggcttgcctggcatcttgaaatcaattgttccgttttacgatttaggcattggctggatcataccagctgttatcggtgctgtggttggtttacttatttcgatgtttaccagcccgccaaagcagcttgtctcataattatcgcaagctaaaacatccccttccaaagaagaaggggatgtttttttattgttcttcatatactaaaatagaaaaattcatgacttttgtacgtaaacacatgttgacatcaggcgtacatcctttataattagtgattgttaatgatgaacggttacctagcaactaattaacagaatatttcaacataataatggaggctttaaatgcaatgaaggcaactttgtcgacgaaagatacggttatcataggttttatgctgtttgctctattcttcggcgccggtaatatgatttatccaccagagcttgggcaatatgctgggcaaaatgtgtggaaagcaatgggtggatttttattaacaggtgtcggtttacctcttctagggattattgcaatcgctctgacaggtcgagatgcgaaaggattagctgataaagctcacccagcttttggaacagcgtttaccgtcattttatatttatctattgggccacttttcgctattcctcggacaggaacggtttcatatgaaattggtgcattaccctttttagcaggtgtaccagcttggctctcacttcttttattcacacttgtcttttttggtattacgtattatcttgctctaaatccaacgaagattgtggatcgtgtagggaaagtattaacaccaattaaatttacgattatttttatcattattgtcaaagccattttaacgccgatgggcgtcattggcacacctgatgtatcctatagcaatgggtcatttttcaaaggatttttagagggctataaaaccatggatgctcttgcttctattgtgtttggggttgttgtcatcaacgccattaaaggacgcggtgtgacaagtaaaaaggcactgacttctgcttgtatcaaagcgggtctgattgcagcttgcggattaacatttgtttatctatctcttgcttatttaggcgcttcaagtacacacgccattggttttgttggagatggcagtaaaatcttggctcagtcttctcaatttttatttggcagtttaggaaatattgtgttgggtgctgcgattacggttgcttgtttaacgacaagtatcggtctcgttacatcatgcggagagtatttctcgaatttattacctaaactttcttataaaatggtcgttacactcgtgacattattcagttttattatttcaaattttggacttgctcatattattgctttctctgtaccagttttaactgccatttacccgctagcgattgtcatcattgttttgtcgctggcagataaatggatgggtcaaagaagacctgtatatgtccttactttgattttaacaggctgcgtcagtttgtttgacggcttagtagcagcgaaactcccgattggaccagtggaggatctctttcaaacgatattacctttatatgatcttggtattggatgggttgttcctgctattttcggagtggtcattgggttcattctttctcttttcacttcttctgcttcccaaaagcgggagaaacaagcatcttaacagaaaaaagctgaagtcctgtaaatggacttcagcttttttattgatgctgatactctttttcttgctgagctaacagcttttgtacagcgccaggtgatgctttttcaacagccgctgctgctatatcaaatgatccgttgtaatcataggcgtaaaatcttcgttctgcctcttttaattgttctgaaagaatatggttttgacttctaaaacgattgccgtattgaatgattcgttcaatttgatccactttactgagcatttcttctgtctcatccacaacatttttgactgtgtcagaggcatcttttaattgctgatttactgccggcatgttgagtggcaggttttctagctgctcgtgcacttgatgaatcatctcctgtgctttttcagcgctctctttcatctcagcaggtacacctggaatattacttttatgcagctggcgtactgtatctgtcagcatcgttttaagctcagccagtgtttctctcgcttgtaattcttcttttcttaatgattgaagatgacctttaaatgtgtcatgcaatgcttttgcatcttcgatgaaggtctccagctgattgatttcatccattaataatgaatatgccacgtgatcacgatcaagcttctcgcggatttgtttcatcagcttttcaatttcttctatacgtttttcgaatgctttctgttgatcgagttctcctgctgtcagcttgtagctttctttcacaagagccgtttctgcctttgtttgtgtgtgatcttgctcgagcttttcgaatgcttctgtgagctcaggcattctgcttttgatttcctgacctgcctctacttctgcctccagctgatcataaagcgtctcaatcgcatcatcgatcatttgcaaaatgcttgatgcctcttctaaattgagttcatcaatgagcaatttttccgctctcgcaagctgtttgtttaaagtctccagctctttcgtgatctggatgtgctccagcttgtaacctttttccgacatttcctgatatccgtctttcagcttcgtcagctgacctggtacggtttgtttgcagtctgcaataagctttggtacatcattgatatatagttgaagctggtcgagtctgcggtcttgctcaagcaaaatttttcttgctttcatgtagtttccgttttctgtttcttcctcgtactgcttgatcccttcccaggcctcatctaagtcctgctccattttgtcataaagggtgccatataaatggctgtacgcaagcagattttttcgaaccgtttgatattgctccttgaccttttcaatttccttgcgattttgctcctcgcttgtgacaaggtctgcaatttcttttaaaatgtcttcaatgttcgaatcagcagcactcagcaagtcctcaatatgtgcaagaacctgcttggctttggagaatcgatatttatcagaatactcttctgcgtcatataatagctcctctacctttggaagatgggctgtcacgatatcgtcccactctgcacgccatctttcaaaaaattgctctgtttctccggtcatttttaagtgtttgatttttgaaatttcttctacaattgatctgtttaaaatttcaattttccatgcttccaatcggtcaatctctttatatatattttttctgaggaaataaccgactgaaaacaaagcaagcaaaatgacaattaaaccgatgataaactccataatgagcccccttgttgtgatctaagtgatgtcagggtaaaagtgtcccgagtagacctgagaaccctttcgtgtccgctttgcatttgtctttttataaacaggatcgtatgttttccaataccatccattcacggttttatgtatgtttttcaagaaagtatttgagcgctttctatcatttgatcacacgtatccatgtgacctgcttttatgtatgcggaagctgtcgttttcattgttattatgataccatgtaaccagcatttttggtcatgatttttcattattttcgctgataaacatgacgtttttcaaaatatcgacaagaggtgacgacatgctgaagcaagatgcacatctacatacaccgttttgcccgcacggctcgcttgattcatttcattcttatattgaaaaagccatcaaaaagggatttgattccataacctttaccgagcatgcccctctgcctccatcgttccatgatccaacaccagagcaggatagtgccatgaagctccaagaacttgaatcgtatataacgaaattggatcagctgaaacaggaatacacaggccaattaatagtaaaaactgggcttgaggttgactatatcaaagagtatgaagaggaaacaagtgcctttttagactgctatggtccagaactagacgatagcattttatctgttcactttcttcctgctggcgatgattatatttgccttgattttgacgagaatgccttccagcagctaataagcctctatggcaccatcgaacaggtctatcaaagctactatgaccaaattcattcttctattctatcatctttaggtcgttataagccaaatagaatcggtcatatcacccttgtgcagaaattcaaacagcttttcccatttgagatgacacctgcactttgtcaaaaggtcaccctttgtcttgaagaaacggcaaaaaaaggcatgtccttagattttaatacatcaggtcttcgtaaaacatatgccagaagtatctatttagatcaatggatgattgatcttgcaaaacagaaaaaaattccgctcatatttgggtctgatgcccatcaagcggaagatctcggatatgcttatgatcaattcgaagacatcatgagttttaaatgagaatctaatgccggcttttttggttctagtaaatgatgaagagagcggctcagttccttaaaatacgtttgatagaaataaggctcatttggatttaaataaagcacctccgttaaatattgcggctgtaaatagggcatcatgagtagtgatttcagctgaatcataaaagatgagatggagagctgctcacaaatcacatgggtgctttttcctttttcaatgatgagctgaaacaaatatttttctttcgttaaataggtcgacataatttctctaatgagcgtcgaatcaatcgttacctctcgataaacgaaacgggttaattgacggtgctcgtgctgataagataaaatatcaaaaaccacatgtagtaagcattcttttgcatgacgagtttccatgtgatggatatgtgattcaatcatgtgaatatagccttcataaaaatcggatacgagctgctcaagcagccctccttttccttgaaagtaataagaaatgtgggcaacgttgacgtttgcttccttcgcaatctcacggacagaggttccagaaaatcctttttggttaaaaagtctgatggcagcttcaataatacggtcttttgtttgcatggttgttgatgttttcatccgctcacccctcttcatgtgtacatacttcaagatgaaggtggaagttccttttacaattgctcgacaaatcccacatgcgagacgcaagttatgtatttttgagatagaaagtaggagattttcatgtttcatgtcgaaaaacagtctggcgatccatcaaaagactatcaattgctcgttaaacaggtcgaagccattacagatggtgagcctgatctaattgccaacctggcaaatgctgcggcgctattgtatcactcactcccagaggttaattgggcagggttttatttagctaaaggcggcgagcttgtgctcggaccgtttaacggactgcctgcatgtgtgcgtatcccatctggaaaaggtgtttgcggtactgcgtttgcaaaaggtgaagtccagcgtatcgctgatgttcacgcattccctggacatatcgcatgtgatgcagcatcacaatctgaaattgtcgttccgctcaaggtaaatggagagatcattggggttctcgacattgacagccctgtgaaagaccgttttagtgaagtagatgaaacctacttaattcaatttaccgaggtactccaaaaggcgttatccacctctacaaatgcgtaatcttacaaaaagcagacatattgtctgcttttttatttttcttcgcagacgcaaggcaccgccattgcttctaaataggttgacttctcctatccagcgtcctataatagagtttgtgtgaaatatggcagcctttttgttcggcttttttgtatcattttgttccttctatatgaaggtgcatcttgtaactccctgctgctggagcgaggatgcatgaaaacataatgacggaaaagacaaagaacagacggtttttatttttcacaaataaaaacaaataaggaggagtcacattatggctcgctatacaggtccaagttggaagatttcccgccgtttaggcatttcattaagcggaacaggtaaggaacttgaaaaacgcccttacgctccaggcccacatggtccaggacaacgcaaaaaactatctgaatacggtttacaattacaagagaagcaaaagcttcgtcacatgtacggtgtcaacgaacgtcaattccgtacactatttgacaaagctgctaaaattcctggtaaacaaggtgaaaacttcatgattcttcttgaaactcgccttgacaacctagtataccgtcttggccttgctcgtactcgccgccaagctcgtcagttagtcaaccatggtcacatccttgttgatggaagccgtgtagacatcccatctttctctgtgaaaccaggtcaaacgattgctcttcgtgagaaatctcaaaaccttgcagttgtgaaagaatcagttgaagtgaacagcttcgttcctgaataccttactttcgatgctgaaaagcttgaaggaactttcactcgtcttccagagcgttctgaattagcgcctgaaatcagcgaacaactaatcgttgagttctactctcgttaatttcatgactctccaaagagagatcaaaaaaaccctagatcccttgattattcaaggatttctagggttttttgtttgctttctcctatgaacaaatgaatttaaaacatagatagaaaacagactatgcacaagatagatgagcaccaggcaaagcttctaaaagcatctctacacatttaagttagtctaactttttaataataatagaagcgttcacatttgtttgggtccctcctgctaaagtttgaagagtaactgctgctgtggaagtatggtttacaagagtaagcgtgtcacctgctgctagagcgaggatggcctgaccgttgttctgttgagtaccagctcctgaaccataaactgtgttcgtcacaggagctccatttacaaatagagtgaattgatttggttctacaccagaaactgaaaaagtaacctcgtagtttcctgggttggtgactataatttgagaagttccaggggcatgggtaataccagcagtagtaattccagttgagtcaaaaatcactggggcctctaaagctactgtttcagcacttagattgtatacatatgcaaattcagctagccctgcacctgtgactcctgttgctccggtatctcctgtggctccggtggctccggtggctccagtgactcccgtggctccggttggaccaatcgctcccgtcgccccgatatctcctgtggcacccgttgctccagtggctccgatatctcccgtggcacccgttgctccagtggctccggtatctcccgtggctccggttggaccaatcgctccggtatctcccgtggcacccgttgctccagtggctccggtatctcccgtggctccggttggaccaatcgctccggtatctcccgtggcacccgttgctccggtggctccgatatctcccgtggctccggttggaccaatcgctccggtatctcccgtggcacccgttgctccggtggctccggtatctcccgtggcacccgttgctccagtggctccgatatctcccgtggctccggttggaccaatcgctcccgtggctccggttggaccaatcgctccggtatctcccgtggcacccgttgctccggtggctccggtatctcccgtggcacccgttgctccagtggctccgatatctcctgtggcacccgttggaccgatcgctccggtatctcccgtggcacccgttggaccgatcgctccggtatctcccgtggctcctgttggaccgatcgctccggtatctcccgtggctccggtggctcctcgaatccctcgtagtcctcgtaatcctcgtcgtcctacaattacttttgtttcacaaatgatgcagcagtttgattttgatagtttctgtttacaacaagggcattttttatacttatcacaacccatcagttgttcatctcctttatcattattcttatgttacatcagtaaataggtgcgattaagttgtgaagatttgattgtattttgcgctaaatttgtctattgttttttcatgatgactagccagtctcaagaagctattcaaaactatataatctatcatgaaaaaaatcccctagaattctagaggatttttttgttccatggttcatcaagtattattaagcgtatagcgatattttttattttaccatccaattactaatcaattgatctgttgtcagcacagtcgcaaattcaacatggagtgtggcaagtgagagccgatggattgtttctgggtcaaaatatgtaccggtttgatctgttagcccaaaggcagctgttgcgtccgaaatcagatacgtatcaaagcccagatttccgctcattcttgtagttgtggatacgcagtgcggtgttgttaatcctgcgatcacgactgtgtcaacatggtttgatcttagttgttcttccaagttcgtaccaatgaagctgctgttcactttcttttggatcaccaattcttcttctaacggtctggcaatatctttgaacagatgtccttcatttgccggatgaaacacagagtctggattgtcggctgtatgctgaatatgaatgactttccagcctttctctctccaaaacctcaataggcggctgatattttcctcggcctctagattatttcgttctccccatttttcatgctcgaacgccttctgtacatctacaatgattaaagctttttgactcgtttgcacaaacgctcacctccgaagattcttattcactacatgtagtgtacgtaatggtgatccatttgtacatgcttttactgttgttttgcctgttttggcattaaaaaaataaaccacacaccagtgatgatgtaatagataccgataatcgatgtacaattagacagcacctcgccaatttgaactgatttgacgaacttcatccaaataaaatagataatgagaaatgagcatggaaaatagagaaagtatccgaagaaatattgcttgagtctgtgtgtcaacgtgtgggctccatatagcgatgacatcaaaaaagacagcacaaggcgctgtctttttcattttttaattcgtattctgtcctccgccattcaatccttctttcacataccctttcacttggcttgaggttaatagaccgatatgtccaacgccgtggatcaggacatttcttgcgccaattaaacgagagaggctgttgacaacaatcatatctgctgagctatagacagatgtgtaaagaattttttgatttggatcagtgcctggtaatgctctgagtgatacgagtccattcgctcctccaagtgtgacgacgttttcaattttatcgccgccgtctagattcttaatatagtataacgtgttcgccccgcccatactatgcgccacaatatctacttttttggcacccgttttgtctagcacatctttgacgaatctggatagacgaggaccattgttgcggttattccctgttttgtctatgaaatcgatagcaaataattggtttcgatcccagccttgtgtaaccaagtaacttttaatcgaagcgaagttataagacgctcctcccataccatgcaccatcactaccggattatgctcagccgctttgatttctttcggctggatgaaagccattgaacctagcactaaggcaagggcaacaagaatttgcaaactctttttcttaaatcgaatcactttcattcccccttattcatcttattcgactctattttatacaagaaaaatatgtcagaaaagtgaacaaggcactgtttgttgctttatttcacagaaaataattactgaaaaagcacctttgactttctcagagccaatgccaaaagactagacaaagtgtctataagcagtctaatagactcttaactgagcacccgcctcacattttgaataaaaaaagcagccggttatcgcagccggctgcacatcgttcttatttgtaattcacaaggaagtatttctttttccctcttcttaagacggtaaattggttttcaattctatcttccgctgaaaggacgtagtctttatcggtttgtctctctccgttgatggaaactgcaccatttgtgatgtcttcacgtgcttgacgttttgatggtgacagcttcgattccacaaggacatcgacaagtgtcaactcttctgtgctgcttttctccattgatggaacatctttaaagcctactttgacttcttcggctgaaagagatttaatctcgcctttgaatagcgcatttgagatattaacagcttgttctagtgattcacggccatgtacaagtgtcgtgacttcctctgctagacggcgctgtgcttcacgtttttcaggtgctgtttgcactttttcttggtaagatgcgatctcttctttcgataagaacgtaaagtattttaagtatttcacaacgtcacggtcatctgtgttgatccagaattggtagaactcatatggagatgttttttctttatctaaccaaatggcgccgccttctgttttaccaaacttcgtgccgtctgctttcgtgacaagcggcatcgttaaaccaaatgcttttgccccttctgcttcagacttacggatcagctcaagtccagatgtaatatttccccactggtcgcttccgccaatttgcagtttacagttttcatttctgtaaaggtttaaaaagtctaaagattgcaggatgacgtagctgaactctgtgtacgaaatacctgtctcaatccgtgagctgacgatatcttttgccagcatgaagttcacaccgaagttcttcccaatatcacgaaggaatgtgatcacattcatttggctgatccagtcgtagttattcacgataacggctgggttctcgcctgcttcaaaatcaagaaattgagaaagctgtcctttgattttatctgaccactgttcgacgatttctgctgggtttagtgaacgttctgcttttttgaagctagggtcaccgattagtccagttgcaccgccaacaagagcaatcgggtgatgacctgcttcctggaatctgcgtaatgttaaaattggcaataggtgaccaatgtgtaagctgtccgctgttgggtcaaaaccggagtatagcttgattttttcttctgctaataattttgttaaaccttcttcatctgtttgctgctgaattaatcctctaaacgataactcttccatcaattgactcatatctcattctccttttttacaattcaacataaaaaacgccccttcgaatgaacgaagggacgatatatatcgcggtaccaccctgcttaaaagacaatacatcacgtcttttcacttacactgataacggacagatccgttctttcactaatcaggacagcatgcatgctccttttcgtaaaagcggttcgtgagggtaattcgaatatctctttgcactgactcgcaccagccgtcagctctcttggacagggaaagatgattctactgaatctcagtcaaaacctttacatattcaactaatgtcattttaaacatatttttgatatcaagtcaactgatgaaaaaattaatcttccattgtcgataggtcgccagccggtaaattcagttcccacgcctttagcacacgtctcataatttttccgcttcgcgttttaggcagtttgtctttaaactcgatttctctcggtgccgcatgtgcagcgagtccttttttcacaaacgtacgaatctcttctttcagctcatctgtcggctcatatccgcttctaagcgcaatgaatgccttaataatttcaccgcggaccggatctggttttccaatgacaccagcctctgcaatggccggatgttcaactagtttgctttccacctcaaaaggaccaacccgctctcctgatgtcatgatcacatcatcgacacgtccctggaaccaaaagtatccgtcttcgtccatataagctgaatctcctgaaacataccaatctcccggcataaagtaagattcatatttttcaggattgttccagatcgtatgcatcatagacggccagccttttttgatggcgaggttgcccatccgatatggcggaagttcatttccggcattatccacaatcgcagcttctacacctggaatcggtttccccattgaacctggtttaatgtccatgcatggataattacaaatcagctgtgcaccggtttccgtcatccaccaagtgtcatgaattcgtttgccaaatacagcgtctccccagcgaatgacttctggattaagaggctcacctacacttaacacatgacgaagcgagctgagatcatatttttgaatgaggtcatcccctgcccccattagcattctaaaggcggtcggtgcactgtaccaaacggtcacacctagtgattcaatcgtttcataccacgtatcagggttaaatctgccgcctaaaatgacatttgttgccccgtttaaccacggtgaaaaaatgccgtacactgtgcctgttacccagcctgggtcagctgtacaccagtagacgtcatcttccttcagatcaagcacccatttaccggtctgatcctgctgcaccattgcaccatggacatgtagcacaccttttggcgtacctgtcgaccctgacgtgtaatgaagcagaaagccgtctttttcatccatccattcgatttcaagatccttcgccgcctggtcaaaggcttcttcataatggatggtccgaacgccatcgatatcttccttttcaccgccgacaataatgacagattcaagtttcggaagctctgcaaacggaattcgttcaagcagatctggcgttgtcacaatgaccttcgcctcgctattttctaaacggtctttgaccgcaccttccataaatgcctcaaataacgggccaacgatcgcaccaattttaactgcgccaagcagaagaaaatagagctcaggggatctaggcataaagataaatacgcgatctcctttttgcacatgcgccttttctctgaatagattgcccgctttatttgtgttgattttcatatctctgaacgtatacttttcatcccgatgtgaatctctgtagtgaagcgccaccttgttcttacgaaacgagtccgcatgtctgtcaatcgcttcataggctgcatttatgtttcctgtttcataccatgagaagttttttcttgcttcttcccatgaaaattctttgtatgcctgctcataatcatttaaatgatagtccccttttactgatggtagcgtttccactttcatcaaacagtccccctttgcatacgtttacaatgaccattatagtatagatgactttttttctcaatttttaaaaaacttatagtgaaaccgttttaattcttgcaggttttaagataaaatagagacgactcactagaatttgaggcggtggatacgtggagcatcctaaaacttattattcaaaaatcattgagcgagaaacaggttccatccttattgaaggtccggtacctgcatcagagcttgcgaactatacatttcatgaaggcctaacggcatttcgcacgccagaggaacagaaacaagcacttgttgaaatagcagatcttccagaaggacgtattatcattgcaagagtggatgagcttgttgtcggctatgtcacgtatttatatcctgatccgcttgagcgctggtcagagggcaacatggacaatttaatcgagcttggcgcgattgaggtcgctcctccatttagaggctgctcacttggcaaacatttacttgatgtgagcatgatggatgagcaaatggagaattatatcgtcattacaactgaatattactggcattgggatttaaaggggacaaagaaaaacgtgtgggagtaccgcaagatgatggagaaaatgatgaacgcaggcggtcttgtttggtttgcaacagacgagccagagatcagctcacatccagccaattgtttaatggccagaatcgggaaaaatgtgagtcctgattcgattgagcgtttcgatcgccttcgcttccatcaacgctttatgtattaacgttcaattcgtttttttggcaaaggggaatggtaaacaatgatgattgaacaaattatggagcgtgatgtgatcacgctgcgaaaaaccgatacgattgaagaggccgtaaaaaaaatgagtgcacatcacatccggcatattccgatcgtatctgatcaaggttctgtcattgggatggtgacagatcgagatattaaaaatgccagtccaagtatatttgaaacagaaaaaagacagctctttattcagcgtcctgttgaggagatcatggtattagagacgattactgctcatccgcttgatttcgttgaagagatttcaagtgtcttttttgaacacggaattggctgccttccagtggtgagacgaggcaagcttgtaggtattatcacaaagactgatttgcttcgtacgtttgtcagactgacaggtgcagatcagcctgggtcacacttagaggttgaagtggaccaaatgacagaaggtcttgcagacatcacggccattttaaaggaacagcatattcaaatgctgagtgtgcttgtgtatccgcatgcaaatgaatcgtctaaagtgctcgtcttccgccttcaaaccatgcatgcagatcatgtgacgaagctgattcgcgcaaaaggatataaggtgctgtggccaatggagcagacgatcaaatgaaggaagcgacctttgttttttcaccctcttttcaaacgtaccagtttcaccaagaccatcccttcaatcagcttcgtgtctacttaacatatgacctgcttcaaaaaatgaaggcgttaacagatgatgagatcgtcgcaccgcgtatggcgacccttgatgaattaaagctcgtccatacagccgattatattcaagctgtgcagcgggctagtgaaggaaagctctctacagcagagggtgagcgctacggtcttggcacggaggatacaccgatgtttgcaggtatgcatgaagcagcttctctccttgttggagggacactcacagccgttgaccaagtcatgatgggacacacgcagcatgcactgaatcttggcggtggacttcatcacgggtttaaaggtcgtgcatccggcttctgtatttataatgacagctcagtggcgattcaatatattcaaaagacatacggtgcaagaattttgtatattgatacggatgcccatcacggagatggtgtacaattcagcttttatgacgaccctgagatttgtacggtctcgattcatgaaacgggacgctatttgttccctggaactggacaagtacaggaaagaggtcacgataaaggctatggctacgcctacaatattccgcttgatgcatttacagaagacgaatcgttccttgaagcataccgaacagcagtgactgaaattgctgctttttttaaaccagatgtgattttgacgcaaaacggtgcagatgcacactactatgatccgttaacccatttatctgccaccatgaaaatatatgaggaaattcctaaacttgcccatgagttagcgcatcaatattgtgatggcaaatggatcgctgtcggcggaggaggatatgatatttggcgggtcgtgccaagggcatggagccgaatttggcttgaaatgaaaggcattacaccacctgatgaactgcctcaggactgggttcaggcttggcataaacaatcgcccgtcactctgccatccacatggggagatcctgacgatttatatccaccgatcccaagaaaagcagaaatcacagaaaaaaatgctcaaactgtagaaaaagcactgatgcccgttagaagagaaaagaaaaatgcataagaaaagcaggcattcactgatgtgtaagcctgctttttcgttttattttgttgattgtctttcttcaattcggtgtggaagttccacaatttggtcatccacttgctctttgttcatcagcttcgtcagcagtctcattgcgacagcgccaatatcatacgtcggctgaacaacagttgtcagctgaggacgcaccatgagagaaagtctcgtgttatcaaagccaatcacttctaaatcctcaggaatcgatacgcctctatcttgtgctccatgaatgacacctagcgccatttcatctgtagccgcaataacagctgttggcttatcagactgctcaagtagatgagcaagtgattcaattccagaatcataagagtaatcgccttcagcgacgagtgcatcgtcaaatgcgatgcctgcttcttcaagcgcacgtttataacctgcaagctttctcatagagttaatcggttctgacattgggccagatacgaaggcaattcgcttatgtcctttttcaactaaaagctgtactgaatcataaatcgcttgctcatagttgatgttgacagatggtgtttgagcctgctcttcaacagatgctgcaagaacaattggcacaggagagcgcttaaattcttcaacaagcacatctgtgatgtttccgcccataaagacaatcccatctacttgtttacctagcatagtatttaatagatgaagctctttatcggtattttgatctgagttgctcaaaatgatgttgtacttatacattgtggcgatatcttcaattccgcgagcaagctccgaatagaagatactagaaatatcagggatgatgaccccaaccgttgttgtttttttacttgcaaggcctcgtgccacagcattcggacggtagccaagacgatcaatcgcttcaagtaccttttttcttgttgttggttttacattcggattcccattcactactcgtgataccgttgccatacttacatttgcttctcttgctacatcatatattgtaacattattcacataaatcactccttcaaatacacttcatatctatagcattcaccaattggatagagacatgtcagatacgaggaaaataatatcctatttgtcattaaaacgatgaaaagagacacataatttttcaatctacatcaaaatgacattcttttatgaaattatacacgttttttcatcatatgaaaacgttccctttctttttataactaaattaaacaaactttaatgagcttgttacctgtaaattgaatcatatttcatgaaaaaccatcgagaacgttagctatgacaatgatcttagcagattgtattgaattttaaaaatgaaaacattgtgaacaagcacgtttgagcttgtaatgtgctcttttcctttcattcccaatctttatcctatttgctccatagaaaaaccgccggacaatcatccggcggcttttctatctatgattatgcgtgaatgttaacaagtggtcttaacgcatctaaccatttttcgaattgtggaatgtccatttgctgtgctgagtcagatagagcaacagatggatctggatgcacttctgccatgacaccgtctgctccaatcgcaagagctgctttcgctgttggaaggagaagatctctacgtccagttgagtgcgtcacatcaacgaagactggtaaatgtgtctcttgtttcaagattggcacagcagaaatatctagtgtatttcttgtcgctgtttcgtatgtgcggataccgcgctcgcaaaggatgatttgatcatttccttgggcgatgatgtattcagctgcattgatgaattctgaaatcgtcgctgcaagaccgcgttttaaaagaacaggttttttcacagatccagcttcttttaaaagttcgaagttttgcatgtttcgtgcaccgatttggataacatcgatatgctcaatcgcttcttcaatgtgagcaggattgacgatttcactaatgacagcaagaccgtattcatccgctacacgctttagaatttttagaccatctacaccaagtccttggaagtcgtatggacttgtgcgaggtttaaatgctcctccacgaagaagttttagtccttgctgtttcgctgctgccgccacttctgcgacttgctcgtagctttcaacagcacatggtccaacgatgaagcgctgtttcccatctccgatcgcttctccatttatatttacgattgtattttctggttttttcttacgagaaacaagaagtgctttgctgtgatcatcttcttgaagttctagacctgctttgaaaatctctttgaaaatatgctgaatcgttgagttttcaaatggtccatcattttcttcaagaatttggtttagcattgtgcgctctctgacaggatcataacggttgacaccttgcgcttctttcgcttttccaatttcttttacaatgtttcctctttcattgatcagttttaaaatttggagatttagttcatctgcttgctgtctcaattgttctagttcattgttgctcatttttgtcatcctttcctctgcccgctctcgctttttattatttcattctctcatgatagggtttattataaacaaagatttcggaattgtcacgaaaattttctttattacccaaacgcttttaagcgataaagtattatgtgtaagattatagcatagttttgattgaagtaaacctttttttataaaaaaaacgtcagcaattgctgacgtttcttttacacattatgttcaagcgcttcttttgtaatgcttgagtgagatgcatgccattttacttttccaccactaaagacgagtgcctggggactttcgtgctttacccccgacttttctgtcacataggatgaaagctcccttgtgttttgaatttgcaagaaataagttggcacgtcttcatgtgcagacgcaaatgcttcaaactcttgaaaagccgcttgactgatcggacatgtcaaactgtgcttaaaaaagacaaaggtcccatcttgattcgttagttgatcaaactgttcttctgtttcaatgagttgttttgacatgatgttctccttcttcactctgtgcagtaagagttagcctttagtcgattgttcgactttttctttgacatcttttatgccatcttcaatttctgatttcgcttcttgtgctcgtacttttgcttcatctgctacatctgatgcttcacttgctaggtcagctgccgcatcttctgcttcacttttcacatgattagcttttccagctgcacgctcttttatgtctttcactttgtctaaaatttggtttgactgttctgccaccagttgggacaattcagacgttttatctttcgcaatcgtcacatattcagtgcctctttcttttgcatctgttgtgagtcgatctgttttttcttttaaaacattcgcttgggtgttcaaatcatcgcgaagctctttccctgacttcggtgctaaaaataaagctgttgttgcacccacaatgccaccaataagtgttccgatcaaaaagtctttgctattgattccgtctttgctcatgattattcctcctatgcgaaaatggtttatttttggtgttttcgttgtttccactttttataaatttcaagtgctgcgttactccagcttaccacatccgtgactttttcttgatttcgttcaacggatgaagaaaccgcaccagctgcctgctttatgcttgaattaaattggttaatcgagccgccaattccctgcaccgcatccacaactgtgttgagttttgccgatttgtcttggatatcttcagcaagctgattcgtcttatgtagcaactgtgctgtctctgtggtgatcccttgcatctgaccttcaagaccttctaaagttgatgcgacattctttaatgtcagctgtaaggattttaatgttttggacaagtagatgacaagaatgaggaaagcaattgcgatcagtgcaacgcttagatatagaataataatcatctgatacctcctttgctgcgggcatattcaattcaataccctctcgttgtatcattcaaacatcgcctagaatgaccgtttgaataataattctacacttattcgccgattcctgtccacagcgaacgaaaaaatgcggcagatgttgacacaattagcccctttgtcacattttattcaaaataaaaaaagtgccgatcaaaacggcacttttcgtttaagtatttatacagcgactttttcataagcacgcaaatatttttgaatgtctcctgctcccataaagatcagaatcgcatcttcgtgcgctttcagcacagatgtgtcttcttctgcaatcaattgggcctgcgggattttttctcgtaaatcttcaatgctcagcttcccaatgttttcacgggctgaaccgaaaatatcgcataggtatacatagtccgctttctttagactgtcagcaaattcacttaagaattgctgtgtacgagtgaacgtatgaggctggaaaacagccacaatctcacggtctggatacttttggcgtgctgcttcaattgtgacttcaatctccgttgggtgatgggcatagtcgtcaattaaaacctgctcaccgactactttttcattaaagcggcgtttgactccgccaaatgtcgttagtgcccctttgatgagctctacatcaatggcttcatagtgacataatgcaatgacagctaatgaattaaggacattatgatttccataggcaggaatgtagaaggtatcataaaacgtattgcgcacgaacacatcaaatgtagtgccttccgtgttttttacaacattgcgtgcttggaaatcattttcttcattgaaaccgtagtacacaacaggtaccttcgcttgaatcttaggcagatgctcgtcatcaccgcaagcgataatggcttttttcacttgaagcgccatgttttgaaacgcatcaaacacgtcgtcaatgtccgagaaataatcaggatggtcaaaatcaatattggtcatgatcgcatagtctggatgatagctgaggaagtgtctgcggtattcgcatgcttcaaatacaaaatactcgctgttttctttccccataccagatccatcaccgattaagtatgaagttggtttcgctgattgcatcacatgggcaagcagtcctgttgttgacgttttaccatgagcaccagtaatcgcaacgtttgtgaatgaatccatgtattctccaaggaatttatggtaacgaatgacaggaatcccttcagaaagggcacgttcaatctcagggtgtgtatcaggaaatgcattacctgcaatgacggtcatccctggctgaatattatctgggtcaaaaggaagaattttaatatttcgttcttctaatgctttttgtgtaaagatatgtttttcgatatccgatccttggacagtatacccagtatcatgaagaatttgggccagtggactcatacctgtcccttttattccaacaaaatgataaacagtcataattgtacctccaacaaacgtctatctgacttacagtatatgacgctcatttcaatttgcaacttgtgattttcgcctctagcgggtcacagatcgcagctccaaataaagattttttccgatcttcctattctaatcaatattaactatgattagtatccgacaactttcctatttctaacacctgctttcgctcatttacataaaaaagcgttctgacaggcatgcgaaaagcgtccaattccaaaattgcacctatgtgctatcataccatgtttatgaaaaaaatgaagtgattttgtttagatcagctgttctaagtcactcagtgtcataaggacttcccttggcttactgccttttgcaccagagatcatgccctcgcgttccatcatgtcgatcaatctggctgcacgattgtagccaattctaaatcttctctgcaaactcgatgtactagcgctattttgctcaatggcaaaacggcaggcatccataaacaattcgtcttcatctgtaatcgcagagccttggagcattaattcctcctgttcgaaaaggaatactggcttacgctgttttctaacatgtgccactacttgatcgatctcgcggtctgatacaaagtttccttgcagcctcgtcggcttgccggagccattttctaagaagagcatgtctccttttccgagaagcttttctgcacctgccatgtcgatgatcgttctagaatctacctgacttgagacagagaaagcaattcttgttggaatattggctttaatcagacctgtaatgacatcaacagaaggtctttgtgtggcaatcaataagtgaatgccgcacgcccttgctttttgcgcgattcggcaaatgctttcttcgacttcgtttggtgcgaccatcattaaatcagcgagctcatcgatcaccacgacaagataaggtagtttttcacccatttgtttttctttgacaagctcattgaatcgtttgatttctctcacaccagagtgcgcaaacagttcgtagcgtctttccatttcatccactacccatttcagagcagctgtcgctgtcttggcatcggtgataacaggactcacaagatgcggaatatgattataaggcgctaattcgaccattttagggtcaattaacagcattttcacttcatctggtgacgctttaaacattaagctcactaaaatggtattgatgcagacactttttcctgaaccggttgctccagcaattaagccatgcggcattttttgcagatcaacgacaacaggctgtcctgagatatctaatccgagtgctgctgttaaaggagatggattgtctctaaacgcactgcttctgatcatctctcgtaagaaaaccattttactgtgaaggttcggcacttcgatcccaatcgtgttctttcctggaatcggtgcttcaattcgaatatcctttgcggacaaactgagtttaatatcatctgacaggttcgtgattttgttcactttgacacctggttctggatgtacttcaaacctcgtcacagaagggccttgcgtgacatgaacgacacttgctctgacattgaaatttttcagcgtggcattgagcagctctgcccgctctttcacccatgtcccgtcctcttctttttgagctggaggtacgtctaatagggcgaggcttggaaacacataaccttgggcatctgctgctttcttttgtccttgcacacgctgatcactttttaacatcatgacgttaaaaggaaccgttgaggtttgtccgcttgcacgctctgtctgaggagatgtctgtttcggtttttcttccatcacttcatgcaattgttcttgctttttttgctgctctatgacaggttctactcgttcagcagcggtctgttcgtctgctgcttgttctattggcatcacttgatcttctactatttccgcttcttctaacatttgatcttcttgcagatcatgttcggcaactggctcagtttcttccaatgctgccgctagcacttcttcttgatggtcttcttcgatggaatcagtttttatttcctcgaccggttctgctgagatgtcgtctagtacctctacttcttctgccggcatgtctacttccatttcaattgcgggatgcgtgtcttccgctgtttcgaatgtcaacggttctatttcctttgtatgatcgacaaactgttctactggctcagcttttatttcttcgtcttcactggaaacatcctgtaccagctcagactctaccggcggttcgtgatacacttcggcttgctgattatgtaagtcagcttcaatatggtcttgagactcagaaaagactggctctttttcctctgtttgaatgaaaggctcgtcatttaaacgctccatcgtcgattgaacgtgatcctgataagcgagttcctcttgcaaagtaagcggggtcacgtctgtttgcatgtccactctttcttctgctggggctggaactgtttcttccatacgattttctttccgtattgacggaatgttcatttgctgtctgacatttcgttcacgctctgcctcttctgataacagggtgactcgctgcgctgtttctgctgctttcatttgaacagaagatgattcttctttcgtctctgttcgtttcggacgcatatcctgatgatagccatagattggtgacggaatttgctctggtttgaatggctttttatgaatgtcaggctgcaccgtttgttttgactcataggtcttctgcttggcctttgggtggccttgcttcgggcgtcttctttcctgctttactccgtctcgctgaggttcatctggaacgagcggaaagcggaagtttcctgctggatattcataatagacttttgtatcttcaatttttttatattctttatgctgttcaaaaactggctgctttggtgcaactggaccttcctcaggtctcacagctttttcttctttcttttcttctcctaaaaatacactaaaaaatttatctaaccaactcatcatttatcactcactttaactccccttacgttttcttgggcgatttttagtataccattgctttttcatgcagaaaagcgagaaaagtgccgctccttgctatttgtactgtctgtagatgaaaaaaagtcactaagtacgtacttagtgacttttggtataacacattcttcgctctgatgtgcccgtttatgggaggttatgcttgaaagggttcgccagcttgatggcttccctctagaacaagaatccctttttcagcaggcgcgtctggaagatctagttcttttgctgaacaaatcataccgcttgatggaacacctcttagctcagcatctttgatgattaaaccgcttggcatcactgccccaaccttcgcaaccacgacatattgcccttgatcaacgtttggtgcaccgcacacgatttgtaatgtttcatcgccaacatccacttggcaaatgtttaatttatctgcattcggatgcttttctttttcctttacataaccgacaacaaattttggtgatagatcgacagtcaacgtttcactgacaccgttgcggtttaaaatttcgttgatatcttgaacaagtgtttcagaaagcggtacagatccgttttcttcaattttcatgtaagtagatgcattgaagatattaaagcctgttgtttcttttgtttcttgattgaagattcttacgacatctccaaacgtctcatgacctacttcttctctcgtcacatctttcaaggaaataaggagtgtgtcgcctacaccttctgcattataaaaaacgttcattcttcaaaattcccttctactgctgttttggtctgcttttagcaagaataaagatcggttcaagtttgccctcatcatataaaaatgacaatgcggtaatcggaaccgtgccgctggcgaagaagctcatcgacatctgtcctaaaatatcatagcctgattcattgcgaacatctgcaatgatgaatacatcttgatgggggacagaaatggccatctgtccttctattttttgcgcgtactcttgtaaaatcgattcatttaaaagtctgcttgcatcatatccgtcatttgcacggaagaaataaaatcggttgcctgccacttcatccattttcactacagtttcaagtgagcggacattgaagcttgcagtttccctgattcgttcttttgtccagtcttcctttttaagcatcttttcatcaattaatctgtaggtgcttccaaggtcaagtgcatagtagattctcgtttcagctgtatgctcatcaaaaacgagcggaatgccatcacttgatgtctccggaaaggaagtggatcgaatgaccggataaatttgcttttcttttcctgaaatgtgctgcgcttcgcctttcatggcacttagcgcctctttcacataataaacgatctcatccaatgtttcatcaggctttacttcccactttgcaatgattggcgggagctctagtgtgattcctttacctgtttgtttatcttcaatacgaagcgtatctttttctcggtcaaactggtgtaaccagctgtcatttgtcagacggcttttgagttcattcgcaagctgtcttgatgtcatttttgccatgatttagactctcctttcattatttagaaagagaatctgttaaaaatgcttcaatctcttccttcgttttacgatccttgctgacaaagcggttaatctcttgtccatttttaaataccaaaaagcttggaatgccgtaaatctcccactctgcgcaagtgtcaataaattgatctctatccacatagaagtactcaaattctgggtagtttgcttcaagctctggcaagaatggttcgataaaggtgcagtccgggcaccagtccgctgaaaatagcaatactgttaagtcttcttgaatcactttttgtaattcttcatttgattcaatttttttcatgtttcattcctccagtttgtatggttaaatctccgaattgtatatagcctttctttctcatccattctgatactaccaaactaatcactgccgggccaacgatatgcaaaagagcgatcgccagaaaaacggatggatgaaatcccataacggtcagtgtcatgagctgtccaacgaggccgctcgttcccattcctgctcctgccgcattattgaccatcccaaagccaatgataccaattggcgcgagaatgaggcccgctatcgtcggcggaataaggataaggggatttttcacaatgttcggcagctgcaattttgatgtgccaataccgacagcggcaagaccgccaaaacgattttctctaaagcccgcagcggcaaagccgaccatttgagcgcagcagccgattgttgcagcaccagcagcaagaccgcttaagtcaagcatgagcgcaagcgcagcacttgaaatcggtgagctgagggcaagtccaacaatggttgcgactagcatgcccatgatcagcggactttggtcagtcccccacatgatgagcctgccaagccctgtcatcatggcttcaatcccaggaccgatcaaagcggcggtggaaaaaccagtgatgatggtgacaagcggtgtcaaaatgatatcaatttttgtctcaccactgaccagcttaccgatttccacaccaattaatgctgcggcaaagcttccagcaggtccaccaagctctgctcctgcagcacctgagacaacacttgcaaaaatgatcagaggagatgcctgtaaccggtacgcaacggctacaccgatcgctgggcccatgagccccatggcgagtgttcccattttgatgatgagcggaagtgataacagaccgcctgctgtttttaaaatcagacctactactagtgtagcaaatagacctaaagccatataagagagtgcatcaatgaagtacacttttggcgaaagggagattccctttcttttcaaataagtcatcaacgtcgtcttcctgctttctcataggaaagacgaagaggcctgtccttcccattatatgtagtattcttacgatgaaaaatagtctctaccatgaatatcataatcatattttttttgctttatcaagcacttcttgtgtaacatgaaaagaaacagggcaaacctttactaagtttgtacaaaaggaggagattgttatgcaactaaccgtctatttagcaggagaaattcatagccagtggcgcgatgaaatcaaggagaaaagccaatcattgaaactgccagtaacatttgttggtccaatggagaatcatgaccgctccgatcacattggtgaggacattttaggtgagcagccaaatgccattttcaaagatgatgctgcttctgatttgaataatttccgtactgagatcctattaaacaaagcagacatcgtcattgcccgctttggtgagaaatataaacagtggaacacggcaatggatgcatctgctgccatcgctaaagggaaacctctcattttgatccgtccaaaagaactgcaccatccgttaaaggaactatcaaataaagcgaatatcactgtggaaaccgtgaaccaagcgatcaaagcattatcttacgtgtttgaacagcaataaaaaaaggctgctctcttgaaagaggcagccttttgattacatttacacctgttgataaatagaatccactgtactttgatcacagtatttcacaagacggacgattaattcttttgccgctgcataatcatccacatgcaatactgaatgacttgtgtgaatgtagcgagcacacactccaatgacagcagaaggcacgccttggtttgaaatatgcacacgtccagcgtccgtaccacctggtgatacgaagtattggtatggaatactgtttgactcagccgtatcgagcacaaagtctctcatcccgcggtgcgtaatcatggttcgatcaaaaatacgcagaagtgcacctttgccaagctggccgaattgtgttttgtcacctgtcacatcgtttgcagggcttgcatctaaagcaaagaacagatctggctgaatcatattcgcagctgcttctgcccctctaagccctacttcttcctgaaccgttgcacctgaatacagatgacaggaaagtggttcgtcttttatttcttttaataattcaatcgcaagtccgcagccatagcggttatcccaagcttttgctaggatctttttaggattcgccataggggtaaagactgttgcaggcacgatttgctgtcctgggcgaatgccaagttcttttgcctcttcttcactgtctgccccaatatcaatgagcatgtctgatggtttcacaggtttgcttttttgttctggagtcagaagatgaggcggtgtactagagacgacaccaggaattggcccgtgatcggtatgaacgtcgacacgctgtgccagcatgacttgactccaccagccgccgagtgtttggaagcgtatcatcccattcttcgtaatggatgaaaccatgaatcccacttcatccatatgaccagccaccatgattttaggtgcgttctctggtcccttgcgtaccccaaacacaccgccaagacgatcctgaatgagttcgtcagaatatttctcaagttcctttttcataaaagcacgcacatggtgttcattacctggggtgccttgtaattctgttaaatttcggaaaagcgacaacgtttcttcattcattctacgatttacctcgtttctatgtaatgaccatatatattcctataaaaataacactcactttatactataagaattctttcggttttccaagtatctctccagaaattttgaatatgctttcaactattcggattccttaacatcaatggacaagttttgtataatggaaaaaacagcaatacggaggtgcagcacgttgaagttaaaacatgttctgattggtgcgagtattggcgtagccgctgcaattgttgcaaagaaagtatttttccctacgtatatctcgtctgaaaaagcattaaaaattgtgaaatccgcttttaaacagcgcggcccgattgatggctcttggatttatactgtaccagaaccgtataccgtaaatggtgaaacgattgatgtgtacaaatctggcattactcgctcagcctttggggagctggaacagtacgaagtcatgattgatgccaaaacaggcatgattgtggatgtcattgattctgtggcttgataaagaaagcttcgcaaaggtgtgtccttgcgaagcttcttttttatatggctttgatttttttgtacacaggatgccacatagcgtcctgtacagcctgaataaggtcctcaggcgtttcctctgcaattccttcatcaatcgctgcttgcgccacacggacagccactgtcgctgaaacggttcgaagctgatcgacactcggcagcatcgctgcacccggctttccgacattgaccatgctggcaatcgcttcagcactcgcaacaaacatgctgtctgtcatgaggcgtgctttagacacaatcgttccaagaccaagccctgggaacactagagcattattcgcttgcccaatttcatatgtgacgccgccatattcgacaggatcaaatgggcttcctgttgtcacgagggcgcgtccttctgtccactcaatgagatcttcaggctttgcttctgaaagaggtgttgggttcgacatcggtaaaatcgctgggcgctctacgtgcgacgccatttcttttacaatttcctctgtaaatgctccccctactgtcgaggtgccaattaagatcgttggttttgcctgtttgacgacctctaataaatcaatggaatgcttagggccattacgggcataatcctttacttcgtcagaacgtcttgcatatggcttttgaaatggctgaatatcaggcgaatcatctgtaagcaatcctgttttatcaatacaccagaaatgatcatatgattcctcttctttgactccgtctctgacgatcgcatcacggatctgctccgctatgccaatccctgcagtacccgctccgaaaatgacgattcggtggtctttcagcggaacctttgaagcttttgcacatgccagaaccgcagcaagtgaaacagctccagtcccttgaatgtcatcattaaatgtacaaattcgttccttatatttttccaatatagctcgtgcattttttgtcccaaagtcttcccagtgtaggagtgcatttggaaaggttgcgcgggcaagctctacatattgatcgatgaactgatcataacgctctcctcgaacgcgagaatgctgatttccaacataaagcggatcattcaagagactttcttggttcgtccccgcatcaagcacaacggccagtacacggctaggatcaatgcctgctgcagctgtataaacagcaagtttcccgactgaaatggcaataccgccaacaccccagtctccaatacctaaaatgccttctgcatctgtcgcaacgattaagtcaatggattcatccacaccgtaagaggcaaatatctcttccataccttccaagtcatcaattgataaataaagccctcttggctttcgatactcgtggctataacgctgaatggctgttccaaccgtcggtgtatagacaatcggcagcatctctgccaagtgctcatttagtaatttgtaaaaaagcacttcgtttctgtcgtgaagtgatgttaaatacacatttttcccaagctcatccggctgtgccttgaactgctcatacgcacgctttgcctgatcctctaatgttaaaactttaggcggtagaaacccttttaaaccaagctcttcccgctcttctttcgtaaatgcaacccctttgtttaaataagggacggacatgacttccatccctcttaatggtgtttcaatgacatcaccatgtacacgataagattggttcacctgcactcttcctttcacaagttcattttgtcgttattttgtgtgaaaggcgaaaaaacatgcagatgatcttttatcttcctgtttctcttttgacttcatgtgcgatttgcccatcttcatcccacttaacagcgcggtaaatcgcatcatgataaaacaagtaccacgcatttttttcttctgcaaatgcctgccatttttgcttagctggaatggaagtcattggataatcatcataagccaagacccataatggatttttatgagcgtgcgttggcataatgtcagctaaatgaatcgctgtttcaccctgacttgtgagcgttaagatgctatggccattgctatgaccgcctgtatgatgcagctcaatgccttctattacttctatgctttcttcaaatggcaccacttgatctgcgattggctcccagttttctttccaatatgtatttcttgaacggatgttaggcgccctcatttcatcccattcaattttggatgtgatgatttttgcttgcggaaaaacagacacgagtttttctccttcacgttttgttaatccgcttgcatgatcgaagtgaagatgcgtcattaagacgtaatcaatatctgctgtttgcataccgagtgccgcgagtgactcttccaatttcgtctcttctgttacgccgtaattgcgtttttgtttatccgtcagcttacctgatccgatgccggaatccactaaaaaatggagaccattccaccgtatgaggatcgggtcacaccgcagttcaatttgattgcgatcgttcaccgggtatttttttgaccataacggctttggcaccacaccaaacatcgcaccgccatccatgtgtgtatctcccccgtttaaccaaaacagttccatgtcacctattttcattgtctccattgctgtcatccctcctttttctatcgtagcaaatacagctgaaaatcgcatgcatcaatcttttcatgaaaaagctgactgcaatttttttgcagccagcttgatgtcacttgttattctggaaatttcacttctgatcgatagataggttgtcccatagacgagaatttctcttcgtattccgtcatcacatttccttctagtccgtccttatgtaaatctaagcttacatacgttaaaagaagtccatatgcagaaaagctctttaaggaatattcaaataacccgcggttatctgttttgaaatgcaactcaccgcctggacggagaatatgttcatatcgctctaaaaaggctttaaacgtcaatctgcgcttttcatgccttgcttttggccacgggtcagagaaattcaaatacacccggtcaatctcattttccgcaaacacatctgtcagcgtttccgcattaatgttcaaaagctttacattttcaacagctgtctctttgattttgtctactgctgtcacaatgacacttttaaataattcaatgccaatatagttgatatcaggatgaagcttgcccattccagcgataaagctcccttttcctgtgccaacttcgatatggattggatgatcatttccaaacagctcatgccatttccctttatatttctcggggttagctaaggcaatatgagcattttcagctaagtaatcatcagcccatggtttatgtcgcattctcaatttgatacacctctattttctttacattttatcaagataccatgaaacataaagacccgcaagacggcatctttatgcgcatacgaaaaagaccagcccttcgcttgagctggtctgccgcatgtataaattgggcgctgaatgcacagtttaaccacataaatgacatgcagaaaaggagcatacgtatgggattaaaccgtcaacatcagcttcaattagtcaaagatattttaaccgatcaccagctggattgctgcgggactgttgcagaatatgaacaggtgggacgcgtgattcaattaatgctggcaaaagaagaccttgatgccgatattcgtcaattattaacagatatttatgattacagccaaaagggcacctctgtcagttcaattgatgcacatattgaggcgcatcaatcgcatttgtcagagtgggtcgagaatattcctctctcttaatgaatgtttaaccgctgtaaaagtgcgctcagttccgcttgcacttcttgctgcgctttttcattcccttttcttttatgccacacgacaaacgatacagtttcagcgaggacgtaccaagccatacgttttcgcaaattgtccgtcagcggggcaccgtacattgagagccagctttcccagttctcttcttcaacataatggtataaaagtggtccaagatcaatggctgggtcagcaatcatcgccccatcccaatcgatcaagtaaagctggttttcatctgtcagcagccaattattatgattgaggtcacaatgacacacgaccttgtcttcaaattgaactgcctccacatgcttctctaagtactggatggcacgtgtgatgtccgaagaatcaatttgctcttttaatatggactgttttaaatgcttcagaatggatgctgggtctagagagtgcttctctaatcgtttcagcatatcaagcaattctttcgatgtatgaatttttcttagctgctctgcgacaggacggtcattcatgtcctttggcttcagctctctgccgctcagccagtgctgcgcagtgatgacatccccattttccatccgttttgtccagacaagcttcggcacaatgccttcagctgacaaaaccgcaagaaacggtgacgtattgcgttttaaaaatagcttttggtcattgtgtgttgcgaagtacgcatctcccgtagcgcctccagcaggagagatgtgccattcgctacctaatatttgtcccaaccagttcatatcaattttcaacccatcatttcttaaaatattttaaatcgtgcttttttagtcgacaaaattcagccgattgaaggtcaataggctgtttctttttttatttatatgatcataaaaacaaaaaggacagctattgagaatgagatgctaaacaatagccgtcctatagattttatcgttaccttcttatactcgtcaagcaaaactagaaaatcaggacaagaaccttatgactaggacattcataagacatggtttaagcacgtaattttaaagagcgatcactcgccttcacaaaaacaggcgttgcaccgatcacttctccatctgcatgaaataagatttttccgtctgcctccaagtacgcttcctcgtgctgaaacagggtaacccccttcattccaaggtgcttacgaaacaccatcgcacttagaaacaagagcactttgaatggattcaaatctgtgacaacgagcgtttgaaagcctggctgtctcgcgctcgcttctggtgctgcttccagcccgcctccgtaataggggtgattacaaacaatcacaaaccacacttggcgaaagacctttttctcgttttcaataaacagtgcaaggtcgaacggcttaaaggaccataaagaatggagaaatgacagcgggtagatgataaacccaagtctcagccgtttcagccacttcccccctctaaaatgcactgttttccttagcacatgcgcatcaaacccagcaccgatatgattgagaaagagaacggattgtgcgctttctgcgtgatcttgaaaggagccgagagaaaatgttttggtcagcattctcttttgctttctcacttctttaaggacatcttgacgatggatgccaagccccttcgccgcatcattccaatgaccggcgggaacaaagcttagctgcacatgttccatttcctttaagccattcaggacttcatgaatggttccgtcaccgccaatgacaatcaggcgcttcagcctgtcatcttgcatggcgctaatttgtcttgccaatacttctgcatgaccttcatgctgggtgagaaacgatcgatatgagatctccaccttttgtagttctttctctatgctcctccatgtacgaagtccttttccatgtcctgctgctggattaacgataaagtaccattcattcatatattagctccactcaggtctcgtttttcgtgaccatccattatgcctttaatcgagccattcctgccttcttttgctgtctgattcaccataagcaagcaatgcctttgtcgccttaaattgctgatgctttgtcggcgcggtatttttccgctgcttttcaaaccaatcttccgccttcttcttatcgacaacctccatcccgtatggaacttccggtaagtcaatataagaggtacggctgatcaggatttttttcacaggaagatcgactccgctttgctgtaaaatctttgacacgacggtgccagagcgtagaaggcctgcacaaggattcaaaacggactgaaccgctttcccattcgcccgcttttcccaaaaacgttccttcgttccgatatatacgctgtcaggctctgcctctaagaaggataaacaaatcacttccagcggcgtaatgagaactggacataattccatctctgctttttgaatgagcagcaccggtttgtacatcacaaaatatgaatccggaagctgtctagcaagcatgcgcagcttttcatcataccgaatatgatgagaaacagtcgaaatgtgggaaatcgtcgagctcgcccattttaattgaacatcatatagatgatctttaaaaaaatgaatgagcttcgtttcatctgtaggaacgtttgtaaagacaccttgctctatatctgttggctcgttaaaaagactcaggtcccgttccttcttcatatcggctgctttcggctttctctttaaggagaatttctttctcttttcctcctcttgttcaggcacttgttcagagatttggtcaaatgaatgctgcgtcttctctttagaagctttttttaactcgtcccacctttgctttttcaagcgaatgaattgattgatgtagtgatgcgggtcttgttcatatcgtgatatataatcttgaattttgataatttgcgccatctgctgctcactccaacttttagaatcatttatgtagtgcaaattgtttgattgcgtgataacgcggggtttcactcggacgtatttcatataaagtcatataagaaacctctatcacgtatggctctttgcgtaaaggcgcttgttctgcaaaagagtgatccgcgttccatttgcgcgcaatcgtcatatgcggatgaaacggtctcttttcaacaggatgccctgctgacaatacggcttttttcaccttttctcttaattgcatgagcggttcactttcaacaggttttgcaaaaaagactctcgggcgctcctttgtgccaaactgtccgacctcattcagctcgattgaaaatgcagcagcttcctttgagaggatctcaagcagctcgatgatcttctttaagcggtcatctggaatggcccctaaaaagatcaaggtcacatgataatcatgaggtgctgtccatttatgaaaagacagtccgcttctttgatcaatgtcttttttgatttgatgcgcaagctgttcagggatatgaatcccaataaaataatgacggttttctgacacaatatcacctgtccttttttaacaaactttacgaatccccattgatgatagtataactaaagaaatgcggaatgagaagaaagggtgtcacatgatgaaggttgcacaaaatatagctgagctaattggcgatacaccacttgttcaattacagaggcttcagccagacaacgcagcagctgtttatttaaagctggaatcgttcaatcctagcggcagtgtgaaggaccgcgctgcttacaatatgatcgtcgaggctgaaagacaagggaagctgacaaaaggagcgaccattattgaaccgacgagtgggaatacagggattggtttagccatgaacgcagcagctagagggtatcaagccatccttgtgatgcctgatacgatgacaaaggaacgaatcaatattttgaaggcttacggggcggaggtcattttaaccccaggagaagaaaaaatgccaggctgtattcgcaaagcagaggaactggcagctcaaattcctcatagctttatcccgatgcaatttgataatagagcgaatccagatgcacatagaggcacaacggctgttgaaatcatagaagctgtcaagcaacttggaaagccacttggagcctttgtcgcaacagcaggaactggcggaaccattacaggcactggtgaggaattaaagaaagcattccctcatttgaccatacgtgtggcagagccgaaggggtctccagtcttatctggcgggaaacctggcaaacataaactcgttggcacgagcccgggatttattccccatattttaaatgagcatgtctatgatgagatcgtgcaagtaagcgatgaagatgcgtacacaatcacacgtcagcttgcccggcttgaaggaattttagttggtccatcatctggtgcagcctgctatgctgcaattgaaacagccaagcaattgccatcagatcaaattgtgatctgtatgacagcagatacaggcgaacgatacttatcaagtgatgtttttcaagattaaaaaaggaacagggcaatgaatccctgttcctttttcttcgtttttcggttaggacgatttagcagtgtttatcacagtctgctcccctgtgataagtaaagcctgttcatcagtaagcgggcataaatcgagcgtctgctcatacttctttaggatttgctgcgcagcatcccctaaataggtattgtgcacatgcggtactggatagcggcttacctcattgaagccttgataggatgaaagctctggtgccttctgccgctcatccatcaaggagatatattcaatgcttggcgccatgatgatactccctgcggattcgccaatgtacagcttaccttttttgatttcttctttcagcacgtcatcgagaccgtgctttctcaattcctgcagcaaataaaaagtgttgcctcctgatacgtacaccacatcattttgtttcatcatctttgtgatttcttcggtagactgctcagctatctgaacgatttctagctgcataccgagttgatgaaaggcttctttcgctgcatccacatagtgtgtgacttcttccacggcactggctgttgggaaaaatgtcacacgtttcccttttaacgattcacccgtaaagtcagacaagagagaatagctgtctttgaacgaagagcataagaacatttttttcactgtgaatcccctcttctctttttctattttgccaattcatacatggcttgtgcatatagtgcggttgctcttagtagatcgtcgatttcgatatattcatccttctgatgtgcacaatctggtctgccagggaagagaggaccaaaggcaacacccgcttctaaagatctcgcatacgttcccccaccaatcgcaatcagatgagctggatttccagtttgttcctcatatacccgctgcaatgttttcacaagcggatgatcttttgagacgtgatgcggagggctgtcgtcaaatttcagaagggtagcccctttgatgccttcgatcccttttttaacgtccttgccgtctgctgtcactggatagcggacgtttaatcctagcttcgcttcttcgccttgtgtatagcggattgtgccaacatttaaagttaaatctccgctaatgtcatctttgcaagcaattcctagctttttccctcttgtatcctgatcaaataaagcattgatttgagaggtaaacgcaaggccgtcatcatctaattcttgtccacttaggaaattggccatatgaatgcccgcattgatgccatgcgcaggctccatggcatgaactgattcaccttttaatgtgaattgcagtccatccgctgcattctttacatcacctaataattggttatcagcaagataagcttcaaaagctgtttttaatgattcagcatcgtgttcttgtgccgctgtcacagtggcagtcgcctcatccggcaccatattcagccgcatacccgatgtgaattgcttgagtgtatagcgctgatgttgttctgtatgttgatatgtaaatgacacaatggcatcaatgatccctttttcagcatgaataatcggaaaatcagcatctggcgcaaatccaatttgcggcatcgcctcatgcttgaaataatggtccacacatcgccaatcactttcttcatctgttccaatgatcattcgaatcttttttgacagcttcatccctgtatcttttaacatcttcagtgcatagaaagccgccatggttggccctttatcatcaatggcgcctcgagcaaatattttattttctcttatatctgctgaaaatggcggggttgtccagccgtcaccagcaggcacaacgtccacatggcatagcacacctacaatgtcttcgccttctccatattcaatatgacctgcatagccatccacattcttgactgtgaagccttcgtcttccccttttttcagcatatactgaagggcctgatcgactttttcaccaaatggctttccttcttttccaccttcttcatcaaggacactttcaatttgtaaaaaagattgtgtgtcctcaatcaaatcgtctttttttcgtatgacttcagcttcccaattcattttttccattcctccttgaaaaaaggttgcattccacccataaaacgaatattatattaattgttttgtaataatgttcgtaaatggaggattttatgtttcagttaaaagaaaaccaaaccaacataaagagagaattaatcgctggtatgacgacattctttaccatggtctatattgttgccgttaacccaggaattctttcaaaagcaggcattccttttgaccaagtcttcactgcaacaattatcgctgctgtcgtcggtacactctggatggcattatttgcaaactatccgattgcgattgcgccaggtatggggctgaatgtctatttcacctttacagttgtcggtggtggcggcatcagctatcaaacagcattcagtgcggtatttgttgctggtatactctttattattttatcgttaacatcccttagaaaacaactgattcaagccattccagataatttaaaatacggcattacagccggaatcgggctttttattgcctttatcggcctccgtcagtctggaattatcgcagctgacccggaaaatctagtgaagcttggcaacttaagctcgcctgttgtcattttaacgcttgtcggcttaatgatctctgttattttaatggtacttcaaatcaatggcgctctgtttatcggcatgttagcgacgacattgattgcccttgtaacaggacagcttcatttccctaaaatgctgatggacatccctgcactgccagaaggtatgctgattacaaatccattcgctgcctttggtgatgtattctctcatcatttatatgcggtcgtcttttccttcttactagtaacgatttttgatacaacgggcacaatgatcggagtggctgaacaagcaggactcatgaaaaaaggccagctgccaaaggtacgaagagccctgctcgctgactctgctgcaacgacgattggttctatgtttggaacaagcccaacgacagcttatattgaatcatcatctggtgttgctgctggcggaagaaccgggctaacgtctttaacggtcgctgcactgtttattgtggcattgtttttcggcccgctcgttcaggctatttcttctttaccatccatcacatcacctgttctcatcattgtcgggtgcttgatgatgaactccgtgtcacgcattcgctggaatgagctagacgaagcatttcctgcttttcttgtgattctttccatgccgctgacatctagtatttcaaccggaatttcacttggatttatttcatatccacttgtgaaactggcaaaagggaaatggagagaagtacatgttcttgtccttatctttgccattttatttttcattcagctctttttcttagaaggataacagaaacaaaaaaggcacattctaacaaggaatgtgtctttttgaaatcagtgaatttttattttgtaaattttctgtgtttcatttttggacgtttgaatgtaacagcattctctaaaccccttactcccattgggttgtaaccgaattcaaaacatggtatataccatatttcgattcatgaagacaagttaaaaaacacgtaaagttgactttttggtggaactagatgcataataacgtgtataatagaataaaacattaagaaacacgaacatttaccattgttgcatgtccttatttcgcagttttagtgtagtaagttgtggttagtcaagtccatccgatcttattgatagggagtggttttttgaaaccttcaacaaaccgtatgatgactcgaataaaatcagtctatatgttcattcaagagaaaggtcttgtgacgacacaagagctggttgatgaattcgggatcacacctagaaccattcaaagagacttaaacgtgcttgcctataacgatcttgttcatagtccaagcaggggcaaatgggaaacaacaagaaaaaaagtaaaaatatcatcttaagcgtataatgaactgtccatataacaaaaagaaccggcctatcgccggttcttttcttttgttccacatctatggtcgattgattaagctgtctaattcttcatccgtcaattcacggtactccccaggcgctagatcttcatctaatgagacagcccccatcgagcgtctttttaaaaagatgacttcatttcccactgcttgcgccatcagcttcacttgatggtactttccttcagtaattgttaaacggatgcgtgtatcttcactttcattcgcatctacttcaaccttcgccggcttcgtccggtaatcatctaaaatcacaacaccctcttcaagacgcttgatgtcttgatctcctaatggatatttcaaatgaacctcgtacatttttggcacatgcttttttggagaaagtaattgatgtgcaagctgtccatcatttgtgaggaggagaagaccgactgtatccttatccagtctgcccacaggaaatggctcccttgcgatatcctccggctcaagtaaatcgacaaccgtttcatcccgcagatcttctgttgctgagatgaccccatctggtttgttcatcattaagtaaatgaattctttatactctacacgctctccatgtacgagcacttcatcattcgatggatcaacatgatctttcacctgcttcgccagttctccattcacggtgactgcccgtgccttgaccagcttctttacatcttttcttgaaccaaagccgctgctagcaagcaatttatcaagcctcatgaaactccacctcttcttaactcttttttcttaaaaatttcggcatacggctgccgagtacacgctcaagtaatcctaccttataagataggaacagatacacaccgccaccagtgatcattgaaatcaaaatgacgatacccgcattaacaattccaccttcatacgaaatcacttggctcacaagctgacatgtcacatacgccactacagccataatcgcagttaaaataccaatgagaataaatcgtttgaaaatcctgcggaacgaatagcctgcatggcgcttaatcatgataaacatatacaagatggacgcactatagcctaacgcagtcgcaagcacagaaccatttccttgtagccagctgattagcggaatgttcagaaccgttttaataatgatccctaacaacagactgacaatggcaaatttttgtttgttaattccctgcaaaatcgctgcattaatggtgaataaagaaaacaataacgcaacaggtgcgtaccagaacaaaattgacatcccaatctcagggtgaacagacggatagaaaaaccaataaaccggtccagccaatgccgaaataccaaatgaagcaggcagcacgaaaaataagatgacctgcattgtctgatcaatttgtctattgagcagcttgtagttacgagctgtaaatgattccgtaatcgttggaatcaaggttaagccaaacgctgttgcaagcgacacaggaatcatcacgagcttcggtaaatataacgtcacaatagacaataccgctgtactaatatcctgatgtcctgatgcaatcatggctctgttaatcgtgtttgtatctatataagaataaattggaatcgccagtccaacaaacacatacggtgccgcatagctaaacagctctgtaaacatttgcttataagataagtcggaggaagcacctgtattcggctgcatcgataagagccgatccttgcgcttcagccaatataaataaagcgtgaataacccgccaaatgcgccgataagtgctgcaaatgttgcataaccgacagcaatgacaagaccgccgtcaagcacttttaaaataataaacgttgctgttaataggaagatgattctgacaagctgctcaatgacttgagaaacagctgtcggtcccatcatagagtgcccttggaagtaccctcgcacaagactcataataggtacaaccaaaagacctaaactgaccatccgaattacatatactacttgatcgacagtcaaaccgcctgtttcattcgatccgccaagctgaatcttggcaaaaatcggtgcggtcaaatataaaatagaaaaggcgataatcccggtgacaagcatgaccgacatacccgccctgaacatttttcttgttgtttcataatcgccaattgcattatatttagaaacaaattttgataccgctgttgggaaaccaagcgtagcaatacttaaaaagatcgtatactgattgtatccatattgaaatagcgctccaccagtagctccaaccattgcgctaaatggaattaagtaaatcataccaagaatacgagagagataagtccctatcgttaaaaccaacgtaccacgaagcagtttattagacatgcgcttaaccaccatttttctaatgaatattcaactcaactattttaccacatcatttcgacgcacaggtaacaaatccaatacagaaggcacaaaaccaatcaattcatatttcagccttacccaattttcgttataatagatgaatgactgaaagcagaaagaggaatgtaacatgaaacattatgatgtcattgtcattggcggtggaccttctggactgatggccgcgattgcatcagcagagcacggtgcaactgttctgttaattgacaaaggaaccaaacttggcagaaagctcgccatttctggcggtggacgctgtaacgtcaccaatcgccttccagtagaagaaatcatcaagcatattcccggaaacggccgttttttatatagtgcattttctgagttcaataacgaggatattatttcgttttttgaaaacctcggcattgaacttaaagaagaagaccatggacgtatgttccctgtctcaaacaaagcacaatctgttgtggatgcccttttagacaggctccgcaacctcaatgtgaccattcgaacgaatgagaagattaaaacagttctgtatcaagacggacaagcagccggaattgttacaaataatgatgaaaaaatttcaagtcatgccgttgtgattgctgttggcggaaaaagtgtgcctcatactggttctactggtgacggctacgcatgggcagaagctgctggtcatacgattacagagctcttcccaacagaagtaccggtcacatcagatgagcgttttataaaagaaaaagtgctccaagggctttctttaagaagtgtggctgtcagtgttttaaataaaaaagggaaacccgtcgtcacacatgtcatggatatgatctttacacactttggcttatccggcccagctgttcttagatgcagcggatttgtggtgaaagaattaaaaaaacagccgactgtccgtctgcaaatagacttatatccaaagcttaatgatgaggagcttttccaaaagctgcatcgagacttaaaagaagaaccgaaaaaggccattaaaaatgttctgaagtcttggatgcaagaacgctatttattgtttttgttagaaagaaatggtattgatccgcaagacacattttctggtcttgctaaggacaaactgcgcgcattcgcccatgattgcaaacattttatcgttcatgcgaacggtacgctctctttggacaaagcgtttgtcacaggaggcggcgtttctgtgaaagaaattgaaccaaaaaaaatggcatctaaaaaaatgcccggtctttatttctgcggagaaattctagacattcatggttatacaggcggatacaatatcacctcagcacttgtaactggcaggcttgccggtatgaatgctgcacttgaagcaaaggagagattttcatgataagacgtgcacttccgattatcctagcagttgtgattagtttgacagccgctgtcttcttaaaactgtctattaccccgttaaaaatcgccattgtgttggcgtttaccatcttcgctgtttgtttgaaagaatacgtctaccggcttcgcaaacgaattgaagaaaaatcatcttcacatatcgatagttgattaatggaagcaaaacatgttacggtaaagtagaggtcgagtgagaaactcgactctttttgtttgaaaatagttgagataggggatattaaacaaaatcctctgcttaaacgtgtagaacaacaggagagtgagatggtgtgaaaaacgtatcaagtgtattttggattgtgattgcgatcacatttgttgccgttatgtggggagctttttctccagaaacattacaaaatgtcacagatcagattcaaacttacattacaaacgactttggctggtattatttgatagtgatttcactacttgtcggcttttgtctattctttatttttagtccaatcggaaaaattacgttaggaaaaccaggtgaagagcctgaatttggccttttttcttggtttgcgatgctatttagtgccggtatgggaattggtcttgtcttttatggggccgctgaaccaatcagtcactatgcaattcaatcaccaacaggagagactgaaacggcacaagccttccgcgattcccttcgttatacatttttccactggggacttcatgcatgggccatttatgcgattgtcgcattatgcatcgcatactttaaatttagaaaagatgcgcctggattaattagttccaccttatacccagtattcggaaacagaattcatggatggattggaaaaacgatcgattgtatcgcagtgtttgcaacagtagttggcgtagcaacaagtttagggctaggtgccgcacaaattaatggtggattaacctatttattcggcattccaaataactttttgactcagctcattattattgcgatcgtgactgttctgttcttgatctctgcttggagcggaattggtaaaggtattaaatatttaagtaatgctaatatgatatttgctgctatactcatgatctttttactctttgctggaccaactgtttttattttaaattcatttacagattcgatcggacaatacttatcgaatattgtacaaatgagctttagattatcaccaaatgatccagaaaagagagaatggattaatggttggacgatcttttattgggcatggtggatctcttggtctccattcgtcggtattttcattgcaagagtttcgcgcggaagaaccattcgagaatttttaattggtgtcttagtggctccttcaatcctcgtgttcctatggttctctatcttcggagtatcagctatggatttacaacaaaaaaatattatagatgtagctggtatgccgactgaaacgatgctgtttggtgttttaaatcaatacccgcttgccatgattacgtcaattttggcacttattttaattgctgtattctttatcacatcagcagattcagccacatttgttctgggaatgcagacaacctatggctcattaaatcctgcgaatagtgtaaagatcagctggggcattatccaatcagctgttgcggcagtgctattattttcaggcggccttcaagccttgcaaaatacagcaaaactcgccgccttgccgttctccattgtcattatattgatggttgtgtcactgtacaaatcattaaatgctgaacgaagagcaatcaaacaagctaacaaagtcaataaaccaagaagtccaagagtaaaaaaagcataaacgtgtatgaaaaaagccgttcctcatgtgaacggcttttttctatacaaacaatttaagattgtcatgctctttcacattcctttaaaataataggatgaaatgattcacaacatggaggtttatatgacgctgcctacattcaagtacaacccagatccagtttcgttaaacgtaatcaaaaaagagcctacgacatgtcctgtttgcgagaaagaaagagaatatgtgtatcatggtccattttattctgttgaagatgtgaaaggaatttgcccttggtgcattaaagatggttcagccgctaagaaatacgatggcatgtttcaagacgatgcaagctgtgacgacgttgagcaagaggaatatatagatgaactgatctatagaacaccaggttatcgcggctggcagcaggaatattggttaagccattgcggagatttttgcgcgatcgtccagtatgtcggatggaaagagatagaacatttagaggaagaactcacagaagatattgaagacatttgcagcggcggaggattaacgaaagagaacctaaaacaatggctcgtcaacggcggagatctgcaaggctacctctttcaatgtgttcactgcaacaagcatcgtttatatattgaccctagttaaacaaagtaaaagaacccttcaaacaggtccttttttgtggccatctattttttatataaaatgagggcagaaaaacagtagagctgttctcctccttgctcacagatcaccgctacattgtacttgatgtcaatgatttgatcgtcatccattccttttaaaaaaagattgatttcactctgcaaatctttttcgtgctcttcatcaaatacagctacctttagcacatatgccactctcccttctctcgctactctatttttatgcacattagggcgggcatatgaacaaaaaaagcctttcatctgtgagatgaaaggacttctgtttacagcttcggttttgtttctcctgtccaagcaagcattccaccaacgacattggtcgcttgatagccttggtcttctaggaaatagcagacattttcactacgtttaccagagcggcaaataatataatactcctgcgtttgatcgaatgcatccagtttctcggggatatctcccattcgaatatggaccgcttctggaatcattccttctgctacttcctcgtcctcacgcacatcaacaagctgaatcgcttcttcttgctctagcttttgttttaattcttctattgagatttcttttactgacacggcgctcatctctccttttaatcacggtgacaccattatagcaaatgaaccgcatcactgtgtattcacccgcttcgattgaaggaaagacggcaggcgtttcttcacttcggcagtctgctgctcactttcaaactctacttttttgaatacttgataggccagccacatatggccataggcgagtatactcacactaaagaacggcacaattcccggcaaataagcaaagagaacaaacagcagagccgagaaaacgagcatacagagtgtatattgtaaatatgagataccgagcaaaagagagaatttcagatagagacgttttttccaatcataatgagccagcagcggaaaaatataaaacaagctcacaacaaagagaaaaccaaagatataaatggcaaaacgaagcacatgcaaaaaccagctcgttggataaataaacgcaaggtctacatatataatcgtccctatgatcagtagcgccactccaatcaagttagagcgtacaaactcctcacggtacaccttccaaaaggtccggaaaacgcccacttgctcatgcccttgtatccactttctcatcaccgaaaataacgcagtggtcgcaggcatcaatccaaagatcccaagccccagcatggtgaacagcagccatagcaaattcgtataggcgagtctcatcacccactcacacattcgcagcattctgctcattgaaccatcatgatccatctctttctcctcctctctttcttatgacaccgtctctttatgaagcaactcttctatgtcaattggacgcttctctgcaacagaccgccacatgccttccccaagtgcaattgaataagcaccagcctctgctcctgccgaaatatcatagtgaattaaaggatctttcccgataaataaatcggccaaaagcagaggatctccgccgccatgtcctcctggctgcttcacgacttcaattgtctcttttgccccaaacatcggataataagaaatcgtctgttctgggaattgaaaaggaattctggatggcacatgaaactcatttgtttcaatacgccccttcgtcccattaatagcaagccggtatccttcgtagggtgctgagaattgaatcgagtaactgaagagggccccttggtcatatgccactgatgccacatatgtatcctcaatgttaatttcctcatcaaaaatacaggcgtctgggcggtaattggcgtattgctgcgtttgactctgacccgattcgatatgatcgtcctcgacttttgagcgttctactctcggattccatcttgcttcataatgacatgtatccttcacatgacatgttccgcaatacctgttttcttcaccctgcaaaggattccaaggacttttatctccgtaataattcagcgccccataggcaaatacttgcttcggcttttgattgatccaccaattgaccaaatcaaaatgatgcgtcgatttatgaatggatagtccgccagagaattgccgcgtgcggttccatcttttgaaataactagcgccatgatacgtatcaatgagccagctcaattcaacagatgtgacccttccaatctttccttctaaaatgagttctttgatctttcgatgaaatggattgtagcgataattgaaagtgactgtgacctttcctttactttccttttctttttccattacttttttggcgtcttttgctgttgtaaccatcggcttttcagtgatgacattgaggtcatggtcaagtgcttgcaaaatataggtgacatgtgtgtcatccctgcctgccacaatgacgatatctggctttgcttctttcaccatttgatcaaatgcctcttcatgaaaaaacgagacgccccgcagtgatggaaaacgctcctgacaaagtgtataccgatgatgatctatatctaaaagccctgtaatcctgtattgctcattgaaatcctctgtgagcggtttaataaacatattgaacgcacgctgactgagtccgcaaattacgacccgtttcacagtccccacccctatttctatcgattttcacgaagctgtttcatgagagacagcgcctctttggacttgtctgcatacacgggaataaaagcgaccatatcgcgatgtaaacgaaaggtatagccatttagctttttcgtgcctttatgaacttgaaccgcataatcgaccgtgttccctgtcctttgatcctcggtcgtatatggccctgccgcttgaccatctatacccatctcttcaagcaattgaaagctttcaggatcatcatacgttcgaaacatttcttccgggacaagcatgatgtccccctcttttgcggtaatttcaacaagaagtttttcaggaatcgccggaaagatgtggacgctatacgtttcttgttccgtttgaaaagccttctcgactaattgatccttcatcccctttgacatatcagaaaaaatcagaacatcgataccgtttgttttcccatgacaggctgacaaacaaaaggcagcgatgaagctgatcaaccatgccgcagcccttttttgcctcttcatgccttttgaaaaacaggcagcttctctagctcagttaacgccataataaaagcgcctgccccgtgcaagtcatttgtgcttctttctctaccgacgtagtaatcataaaatccagcggatgttccgatacatatatcattgatggtaaaatcaccgttttctgtcacagccgtcttatgctgaattaagccttggtaagctttcaccacatgatctgtgtagcgggggctgacatacccttcgttcatggcttttgccatggcgtacatgaataaacacgatccagagctttcaagccaattgtcgctatgagtccctttatcaatgatttgatgccagagacctgtgtcttgatcctgatacctagctacactctccagcatgtctgtcagcgtttccttccacacctttcgcccctcatgctgctttggcagatcctcgatcatgtctgctaatgcaaggacataccagccgaatgatcttgcccaaaactcgggagaacagcctgtcttttgatcagcccatggcatcacttttcgttcgtcccacgcgtgataatacaagcctgttttttcatcttttgtatgctttctcatgagatgctcttgctggatcaccatatccaccagttcctcttcacctttcaactttgcatactttaaagcaaaaggtcctcccatgtagagaccatccagccacatttgataagcataattgtctttatgccaaaatccgccctcagatgtgcgattcaatgtgcgataaagcccgcggagcttctctgctgccagcacataccgcttctctcctgttcgttcataaagagggaataaaatgagccctgcttggatcgcatcaagctcatctcttcgaaatagcaggtttccatactcatcaatgagcgaatctgcgtagcttttcacataattgaaatacgtctcgttccctgttgactcatataacttcatcacaccgcaaagaaaaacgccttgatgataatgccatcttccagctggaggcagctcaatcggtgtatgcgctttcataattgtttgtgctaatttctctgcatgctcaagtggtgatccctttttagtcgataatgtcatttttcttcatctcctttttagtaaataccttcttccccaaatttcttcgctaaacggttcgccagcatgaccaaaatgagtccaaccgctgctttaaataaaccaacagctgtactatagctgaattgcccttgcttaagaccagctgtataaacatacgtatcaaagatttctgctacttcccggttcgttgcattgagtaataaatagacatgctcaaagccaagctctaatgtgtcacctattttcaaaataagcagaacgacaatcacacttttaatggcaggaagcgtgatgtgccacatttgtctcagtctgccggctccatccattttcgctgcttcatatagctgcggatctactgctgtaatcgccgctaggtaaatgatcgtcgaccaccctgcttcccgccagatcacttgtaaaatgtacatcggcctgaaccattcctgactaagaaggaagttaatcttttcccctccaaagaaagcaattaattcattgattaacccgccatctactgttaacaaaacaaaggataaggacacgacaatcacccatgacatgaagtgaggaatgtatatcatcgtctgcacaaatttcttaaacaatgccaatctgacctcgtttaaaagcagggccaataagatcggaattggaaagaaaatcacaacattcatggcaaataaaatcagtgtattttttaataagatgaaaaatgttggttctgtaaacaaacgaataaagtgtttgaagccaacccactcactgccgagaataccgagaaacggctggtaatcttgaaaggcaatgatcagcccccacatcggcacatatttaaagacaagaaaataaatgagccctggcaaaatcatgagatacaaaaacttttgactaagcatttgatcaagtaagcgctttcttctttcttttttcaaagctgccgcaggcacacccttggcagtgacatcctctgttttcatagataaagcctcccctcatgctgatgcatgtgttaactgtatcttaaggatgaaaaatccgtctacaatcatatcatcagatcatatttacttaggggaagctactcaaaacgttacataaaacatgagaaaatgatcctaatctcagaaaatgattattgacaaacctaccaaatttttggattaataaataaagaggaaaagattgttccgtttgaaatggggggttttatgaaaagaaggcaatataaattttattacaagctcgtcacgttttttttcatgcttagtacgattcctgtcatcattgtcggtattttttcttatcagcattcacaaaaaacagcactcgaaaatatctcaaatgaaaagctggacagcgttaaacaaacgcaatccaatattgagcatattttaaagactgttgatcattctctcactcactatgtcagttcgccgcctctccttcaaacactggcagaacctttaaatccagaccaattccagctttataatcaagtacagcaggaactgaactacctgcaaacctttgacaccgatctgtccaatattacactcgtcagtaaaatggaagactggtacatgaacaattcggggctttatcatgtcacaagcggagaccaagagaaagcgctcacctcttacctcaatattccgagtcattccagctgggcacttgaagagaataatccacttgttgcgacaaaagaaggaaaggcctccttttgcaaatacaatgtgaacttaatcaaacaactccctatgaacagtgtccagaaaaaagggatcgctgtcgccagcattccgagctgtacgattgctgacaatatgccggacttctctcaatctgacagtatgtttgtcattgatactaacggaaaagtgctgttacataaccgcaaagaacaaattggtgaatccttgaaaaatcaagagttcgtcaagcatgtcctatcacgtgaagaacgatcaggtcaatttaacatgaagattgaagaactaaactatcaaattacgtttcaaaaatcagactataacgaatggacgtacctatcctttgtttctattccagaacttaaggcacaaacgaaatcaattgggtggatcacctttattatctgctttgttttgttagcgctttcattgttattttcatggtttgggtccagacacttttataaaccaattcgcttgttatacgagtcctttgcacgcaatgaatcctttttgcaaaagcagccttttcaaaatgaatttgagttgattgagtcgagtattaaacaaatgaaggatcaaaacaatgatttagaggaacgtattgagcaacaagtcacgcacctccagcaatactttatggtgcggctattgctcggaaagctgacagacgaagagattaacaaccggttccaaagtttaggattccctcaggactggtctcacttatccatgcttgtgacccaaattgatacgctaaaaggaacaccttatgaaaaaaaggatgctgacttacttttatttgcgatcaatggactcattgagcagattattccgcaagaggagcatctgcagccaacagttgtcaatcagcatcaaacgacgattatcctaaatcactcaaagtcagatgaagagtttactgaatatttaaaccaattagcagaaacgattcagttgcgtatcgaggaagagcttggtttatcgatcagcatcgggatcagccgccagtttcaggagcttacgatggcaaaacaggcttacattgaaggaaaagaggccttaaaatacaggctcaaagcagagaaaaagtccattatcttatatgaacatatccagcaaggaaaaacgtttaaaacccattttccaaagcagctgcagcatgatttatttgatgcgatgaaagcaggtgatcaagggaaggcagatcactatttacatgtgctcctgcaatccattttctctaaaaatgcaggaccgcacgagtaccatatcgccctcgcccgttttttaaacaatttgattgagctgatgcatttgcttggcattgaattatttgaggtcgaagacaataaaatgctgtatgatacgatttttgaatttaaaacatttgaagataccgaagcatggctaaaacatgagatcattcggccgattattgaccagctaggtgcacgcgaggaatcacaatacaaaaacatctcagaaaagatcattcatatcattcatcaagaattcgactcagatctcacattggatgaaatcgctacacgcctgcattacaacccaaattatttaagcagtatctttagaaaggaaatggatatttccttcagtgaatatctctcatcctacagacaccatgtcgccaaaaactggctcgtggagaccgatatgtccgtcaaagaaatttcggaaaagctgaaatataaaaacccgcaaaacttcattcgttccttcaaaaaactagaaggcacgacccccggcaaataccgcgaccagaaaaaaggcatataagacaaaaagtcccgctctcataggaagcgggacttttttatttaaattgttcatttaaaatgctgtcttccagcactgaaagcggctctccgtacacgcgttcaatatgagctgctccccagtcacatagcgcattcagaattctttcgagcgactgaccgtattcacttaattcatattccactttaggcggtacttgctcatacacgattcggttaatcaccccatcactttcaagctctctcagctgttgtgtaagcattttttgtgtgatgtttggcatgaggcgcttcaattcacttgtgcgtttttttccatgtgttaaatgacataaaatcacgcacttccacttcccgccaatgacctcaagggtcgcttccacggagatattatattttttcttttccattaaatcctcactcctctttatacgaataggcactttttagtacctatattacaaaaaagtacgtactttttttttcgtcatctatgttagataataactcttgccgatcggcttcgtctatcaaaatgtcatcacagaaggatgtgaactgattcatgaagaaaaaacaaaaccactttgcccttctcgcactagctattagtgcttttgctataggaaccactgagtttattagtgtcggtcttttgccgatgatttcagaggactttggagtgagcgtcagtcaggctggctggaccgtctctttatatgcacttggggtgacattcggcgcgcctattttgacttctttgacttcaacgatgaaaaggaaaacattgcttttgctcattatgctcgtctttttgattggaaatacacttgccacgatggctccgaccttttcagtcctattaatcggacgggtcatttcagccctatcccatggaatctttatgtccatcggttctacaattgcagcaagccttgtagtgaaagaaaaacgggcaagcgcgattgcctttatgttcactggtttaacagtagcgactgtgacaggtgtgccatttgggacatttcttggtcatgagctcggctggcggacatcatttggtgtgattgtgatcattggtctaatcgcactaatatctaactattttcttgttccatctcaattaaagcaaggcgtgaaaacatcatttaaggatcaagctgttttattaaaaacaaaaagaatcttgcttctatttgtcattacagcaacaggatacggaggaacctttgtcgtctttacgtatttatctcctcttttacagcatgtgacaggccttgcgccaggggcggtggcattgatcctgcttttatacggaatcacgatcgcagctggaaatgtcattggcggaaaggctgctaatgagcagccaatgaaagcactcatttacatgtttatcatccagagcatcattttgtttatccttagcttgactgctggatttacagtgctaggcattgcaactgtcatgctgatgggactttttgctttcatgaatgtccctggattgcaagtagctgtcgttgactttgcagaaagatacacaccaggagcagtcgacgtcgcttccgctatgaatattgctgcctttaatgctggtatcgccatcggctcatttttaggcggcatcgtgacagatacccttgggcttgtgcatacaggctgggtcggcggtatcatggtccttatcgcagccattctcacgatgattagttttcgaatcgaacaacaagaacaaaatcaaaccatctaaggagtgttcaatatgaatcatttacaaagtacaaaaacattaaacaatggagtccacatgcccggatttggtcttggggtattcaaggttgaagatggcgcagaattaatagacgccgtcaaaacagccattcaaataggctatcgcagtattgatacagcggctatttatggcaatgaggaaggggttgggcgcggcatacaacttggtcttacagaaacaggactgcgccgcgaagacctctttgtgacatcaaaagtgtggaatgccgatttaggatatgaatccactctaaaagcatatgaggaaagtttgaaaaaacttcagcttgactaccttgatctatatttaatccattggccggttgaggacaaatataaagacgcttggcgttcgctggaaaccttgtatcgagaaggaaaggttagagccattggtgtgagcaacttccagccgcatcatctagacgaactattaaaagatgcagacatcataccagctatcaatcaagtggagtttcacccaaagcttacgcaggaaactctctatacgtatttgaactctcgcggcattcaaatggaagcttggtcaccgctcatgcagggtgaactgctgcatcatccggtgatcaaagaactctcggacacatacggcaaaacacctgctcaaattattttgcgctgggatgtgcaaaaaggcgttatcaccatcccaaaatcaacgaaagcgcatcgtttaaaagaaaatgcagacatatttgattttgccttatctgatgaggatatgaaacgcctgtctgatttaaatgaaaacaaacgtatcggaccagacccagacaactttgacttttaatgaaaacacccccgctttttaactgtgcgggggtgtttatgttgattattttgattttttaaaggaagcttcatattcttcaatgattttattgccaccatttgatttccacttctctacatctttcttaaattgatcttcactgatgtctccaagaatgaacttataggttgcatcatcgatgatttttttcaattcatttcctcgttctgaggctgtttctgaatacaggctttcagcagggttggcgacgatgatcttttgattgtcttcttccagctcttcatattttgtacgaaccgcatcccctttatttttcaagtaccttttatcaatgcctactagactgacaagcggctgtacatctgtctgccagcttttcacttggctttcttccctcacaaatgtatttccttcctctttcttataatgctcgccatctataccgtacgtcatgagaccatagacatcttcttccgcaatgcgatcaaagaaggccaaaattcgctttaattctgcctctgatttcacgcttgttttagggaatgcgaagatgccattatgaccacctgatgcccacacccgttctttgccatctgggcctttgattcggtttaagatatcgactttcatgtttttatctgtcgcatcatctctcaagttcacagcatcaaccatatttccaacatagattcctgcttttccttgtgagaataattcctgctgctgtgttttgcttgttacagggaagtctttgttgatatagccattatcacgcagtttcttcatatatttcatcgtattcatatactcatctgtcataaattctggcgtgaatttgccgttttcttctttccagtctgttggcactccctcatatgaaccaagtgttttaaatgctccataaatcaaatcgttccgatccgtaaagccaattgtatccgcttttccgttttgattcggatctttttcagtaaaggctttcgctacctcataaagatcatccaacgtttttggtgtatccaaatttaaattttcaagccaatcctttcgaatgacaattccttgtcttgaaagtggtctctctctataaatgccataaagcttaccgtctatagaggcgtttttattaatcagtttgttcatcttacttaaatttggataatcctttaagtacggaccgacttcccagaacatacctgatctgaatgcattaatagcagacgaattcttaatgtcttgaatcgtcacaatctgcggcagattccctgcagcaagggcagaatttaaccggtcttccttcacagcatcaggcacccacgtaatatcaagttctgtatttgtgagcttctcaatctcctttaaaaccgaatctttcggcggctgctggtgatacaaaatggccatccatgtcagtttcacttttttgtctaaatcaactttttcatccgatgaacttcctttgcttgaacatgcggataaaataccgcttgctgcaaataacagaacaaacgcaatcagccataatttccttctccccataagatccctccgttgttccttctttttaaccttttacagaacctagtaatgcccctttgttgaaatgcttttgaataaatggatagacaagcaaaacgggaatggtggctaccacaatgacagccattttaatcgtttggtctggcggtggtgtggatgatcccatatccgacatatccccctgcattccgctcgaaacaatgacaatctgccttagaagcacctgaatcggccatttcactgaatcatttaaatacaggatggcggtcatatacgtattccaatacgtcacggcataaaaaagtgaaatggtcgcaatggctggcaaagaaagtggcagcacaattttaaagaaaatccctaaatcgttacagccatccatcttcgctgattcctcaaggcttgccggaatgttttgaaagaagtttttcaaaatgatcaaattgaacgcattgatcgcaaccggtagaattagtgaccaataggtatcaagcagaccaagagttttcaccacaataaacgtcggaatcatcccaccgctaaacagcatcgtgaagacaacgagaaacatcaatgttctccggccttttagctcctgacgagacagcccatatgccatgagtgaggacaaaaacatgctgacagctgttccaacgagtgtcacaagaatggacacaataaggctgcgatacacaatatccgttgagaaaatataccgataggcctctaaagaaaaagtggtcgggaacaagataaatttcttcgtgatgacctcttctactgtagcaaaagaggcagcaatgacatggatgaacggaagcacacatattaatgcgaacatgagtagaaaagagtaattaaataagttgaacaatcggtctttaatagaacgatctatgttcatcacacccttcctttgaaagcgttatcattttatccgaaaataagctgcagcctgtgacgatatcgtgattaaaatgtaacaaacgagggaagaaagcgtctataatcatcttgacagaccaactggatcgatcctgtcagtcgtgcttttatgctcatgaaacaaaagaataagatcatcagctaatgacatgattatgccctatgcctgatcattttcttcaaggatttccgtcgtattcacatcgggtatgtagcctaactcctgcttcgtgtttttcatagaccaaggcttttcttcgttttctgatacggcataatatgtgccaaagggaacggccgtttcaatcgctgcctttatcatccctgctagatcttcatgtgaaagaagtgttcgttttgttcgatctttctcgtgtaatgcctccatctcatccgtcacaaccgttccaatccgtaaattgataacagacattcccgtttgatcatggaacaaacgacctagctgttcagaagcaaattttaaaatgccatagacattttgagtcgcaggtacatcgtctgttgtaatatgtcttcctagtaaggagcgtccatctttttcataacgatcggtcacgtgattgctgcttgcaaaaatgacttttcgaatgccgagccttgctgctgatcgaaacatagaataagagctcctccaaaaaatatcactcattttttcaaactcctcacgattcatcacatcatacgtcatctccatgtttaaaaggtgtatgataacatctgtatctcgcggaatcgctttatataatccctgttcattcgttgcatctgccaaaatgactcctttttcacagcccgtttgatcaatgatgatgatctcgtactcagaagagagctcttttgttaaaatacggccgatcacaccgcacccgccaatgatcgtgatctttttcatctgtctcctcctttctaatgacgtagtatgtccaagcctttatagattacagccatttttttaagaatcgagtggcctcgtgacgcatagcggctgtttcaaaatgacctgcatgaagaccaacaagctgataacgttcttttaatgaagccacttgatatgtttgactcaatcccttttgaatacgtgctacgccttcagcgggggtgagtggatcaagttttccaactaagcttaaatgcggccttggaaaaatcatttcctgaatatcagctgccgtaaagtgctttgctaagcttggtacatagtaataaaagccatgcctgtctaaattgttcgtttcaattaatgtgtggtgatcgacctgtgcgcaaagatcaatacacacactgactctctcatcaagcgcagccgtccaccaggaaagaagcccgcccattgacattccaaaaacagctaaccggtccggcagcacatcaggtcgagacagtacataatcaatggcacacatgctttcatatagcatcatgccccacatcactttccctgttaaaagcatttccttaaaaatttcactttcggttcttcctcttctctcaccaaatcctgcatgatcaatagccaggacactatagccttttgaggtgaactctttcgcatatgaaggctcttgcaaataatgagcacccttgatgagctcttccttcccatcgacgtagttcccgccatgagagtgctgaaacagcacaacgggtctttttttcactgtatccttcggcttcacaaaataagcgggcacttcctccacaccatggattgaaagaatgagtgtttcgactacatacgattcacgatcctcaatctttaacgtatatgcctccacgcgatggcgttctggcatttctcctaatagactgagcagttgttctcgtttgcttcccttttccattgacatcactcctccttttgttgatcacctgtaaacatacgagatcgatagtccaatcaccttgttttcgacaaaattatgtcccgggaaataaagaacacccaccggttcataccgatgggtgtcatcattaatttgcaacaatattgacaagcttcccaggaaccgcaatcactttgcgaatggttttcccttcaagctgttcttttacacgtgcatcatttttcgcaagctcttctaactgttcttttgtcgcatcagcagggacagttaattttgctttcacttttccattcaactgtacgacaatttctacttcatcgtcgacaagctttgactcgtcatattgcggccatgcttcataagaaatagacccttcatgaccaagcttattccaaagctcttccgctacatgcggagcaattggagaaagaagtttcacaaagccttctgcatattctttcggcagtgtatcagccttgtaagcatcattgataaacaccattaattgtgaaatccctgtattgaagcgcagaccttcataatggtctgttaccttcatcacggtttcatgatagctgcgttctaatgcgcctccagtttgctctgttattttatcactgattgtgccatcttcgtttgtgaatagacgccatacacgatcaaggaagcggcgagcaccatcaagtcctgtttcagaccaagcgattgatgcatctaaaggtcccatgaacatttcataaaggcgcaatgtatccgcaccatgagattctacgatatcatctggattgacaacatttccttttgatttactcattttttcattattttccccaagaatcattccttggttgaacaatttcatgaaaggttcttttgtcggaacaacgccgatatcatacaagaacttatgccagaagcgcgcatatagaagatgaagtacagcatgttctgctccgccaatatatacatcaacagggagccatttcttcagcttttcaggagatgcaagctcttctgagttatgtgggtcaatataacgtaagaaataccagcagctgcctgcccattgcggcattgtattggtttcacggcgtccttttttacctgtaacaggatcgacaacctcaacccaatctttgatattggctaaaggtgattcacctgtaccacttggcttaatctcagtcgtcttaggcaaaatcaatggaagctcttcctcagaaacagctgaagacgttccgtcctcccaatgaataattggaattggctcaccccaataacgctggcggctaaatagccagtctcttaaacgataagtgactttcttttcgcctttttgatgttcttccagccatgcaatggctttttcaatcgcttcttcttttcctaatccatcgaggaaatcagagttaatgtgttttccatcacctgtgtacgcttctttttcaatgtctccgccttcgacaacttccttgattggaagatcaaatgttttggcgaattcatagtcacgctcatcatgggcaggtaccgccataatcgcgcctgttccataagtagccagcacgtaatctgcaatccagatcggcatcttttcaccatttaatggattgatggcataagcgcctgtgaaaatacccgtcttcgtttttgcaagatctgtccgctctaagtcgctcttagattgaatgtctttcatatatgcttcgactgcttctttttgagcagctgttgtaattttttcaacaagtgcatgttctggtgcaagtaccgcataggtcgcaccaaacaatgtatcaggacgcgttgtgaatacagtaaactgttcatcatgtccttctacttcgaaatgaacatgtgcaccttctgaacgtccgatccagttacgctgcatgtccttaatgctttcaggccaatcaatatcttctaaatcttctaacagcctgtccgcatatgccgtaatctttagcatccattgcttcatgggacgtctttcaactggatgccctccgcgttcactttttccatcaatgacttcttcatttgcaaggactgtgccaagcgccggacaccagttcactggtacttcatcgatatacgccaatcccttttcgtacaacttcaagaaaatccattgtgtccatttataataattcggatcagtcgtgttgatttctcgatcccaatcatacgagaaccctagtgattgaatttggcggcggaagttattgatgttctcttctgtaaagaccgcgggatcattccctgtatctagtgcatactgttctgctggaagaccaaatgcgtcccatcccattggatgaagaacatcatatccctgcatacgtttcatgcgtgataaaatatccgttgctgtgtagccctcagggtgcccgacatgaagccctgctcctgatgggtatggaaacatatcaagtgcatagaactttggtttatcttccgagtcagatgtggcgaatgttttatgtgtcagccaataatcctgccacttcttttcaatttcccgatgctgaaaactcaatgtgaaaacctcctttaatatgtacggctgtatctgctcagatgaccactgcaagaattcagatttttctaaaatcaacaaaaaaccctcatccctggaaagggacgagagattttttggttcccgcggtaccacccttgttagcgtaactttctgtttgtacgctcacttaatatctttaacgcagacatgcgacagaagctttaacgcaactgcaactctgaggcgagttcagaagcagatttgattgactttcaccagccgtcaattctctaaagacaaatactgctttcctactactcctcttcactgttcttatcgtaaccgtcatctaagtagtattttatagaattatgatcataagtgcaagcaggtttgtatacaatgggaatgtaccctagatcagggtaaagtagaggaaattattcgtgtggagatcggttatgacggttggagtctgcattctgtgaatgctgttctcttacaaaatcaaagcttcgcagaactgcttctcctccgtaacctgaaataattgataagatgaccaagtgcagactagaatcgggatttgaggataagacaagcagtgtagcggcaatcatcccaacgagccaatcttcaataaaccctaaataaataaacttttttgtcattctgggcttctctagcctgccttttttctttacgtgaccgagaatgcccatgacccctccaatggcgcaagcaataatgacttgttgcagcattttcatcaccttcctaaagcccttagaatagtaaagcgacttcaggctgtccagccccctgtaatgccattctgctgttccgtcataatccatgtaaaaggtctattctctctaacgaagaaaaaaagcttgtttcttccattatatgtgaatgacccaaaacaatcttgatgcattggaatcatttttgcctaatccatattaactatttttgtcattttatgaattatgagcaattgattccttctttttctaaagaaaagtctccttacttactatattctaatggaggacaaactatgatgacaaatttaacaaagccattgcaatcgttgaaacagaacatatgttatgttacgttagtaaggagtatctttggttgaaaagacaaccatttgatatgtctcatagcagcaacaaaggagggtaatatggtcagctcgaacatcttcggcttacaaaaacagcttgaacttataaaaaaagcgctagatcatgcgcggatcggtgttatcattacagacccttctttagaagataaccctatcgtttatgtgaatcatggttttacacacatgactggatacaaaccagatgagattctcgggcgtaattgtcgattccttcaagggaaagacacagatcaagaacagatcgatttaatacgtcatggaatacagaataaaacacctattaccacacagctaaaaaattataaaaaagacggtacttttttttggaatgaactcaatatagatccactatacattgaacaagatgataaaacttttttcattggctttcaaaaagatattacgaaacagaaagaatatgaacagctcctagaagattccttacaggaagtcacctctctttcgacgccaatcgtcccaatcaaaaatggtgtatctgctctgccactcattggaaaactatctgaagaacgctttgatgccattgttgcgaagttaacttgtatattagatgattcaaaggatgattatttaattgttgatctttctggtttaatcgatgttgatgattccgttgcagcacgtattttcaagctgcaccatcttctcaatttaactggaaccgaactgatcatcacagggatcaaaccgcagcttgccatgaaaatgaaagacttggatacagatttccaggatacaatcacttatttgacggttaaggaagctatcaaaggattaccattagctgaaaaccctgtgtaaaacagggcttttttagttaaaacaccccctaaaaatggaaatatgaggtataattggtgtaatgaaagatataggggggcttctagatgatgatgttactcatcataggtcttttatgtgtttgttttgccgttggatatgctgtcaatttcttattactcaaacaccaaaacgcgcagatcttttcaaagaaactattttatcctttcttaatcttaggtctcatcttttccattatgtcattaccgtttgctgccacagatgcaccgaaagcacaagcagatccatcttcagaacagctgttaaaggatcaaaagcagctcacatctgacataacgcgcttaaaagctgataaagaagaacttaccgcttctttagaggacgtaacaaaggataaagaagagctagcgaaagagctagaaaccatcacctcagaaaaagaaacagtcaaaaagcaagaaaagactattcaagcgcttgaagagaaaatagacaagcttacctcaagcaacgaaacgctcaaaaaagagaacaagaaaagtagcagcgatacagagtcttctaccgttcagcgctccgctcctaaagatgaaggaaaaagtacaggcggtcatgaatcacagaaggaaacaaaaaaagaatctgccgcctgtaacatcaaaggtagtgtcaacggtatttatcacacaccgagcagcagatactactctagaaccaaaaatgtaaccaaaatgttttgctccgtagaagaagcagagcgtgcagggtaccgggcacctaagcaatagccatgtgtcacgaaaaaaagaacctcctgtcagccccatagggtgttttaggaggttcttttattagatttctcttcttaatgctgataatacattcgtttttgttgctttacgtgctgggttgagccctgaaaggatcgctacccctgcgctaatcactgttgctgtaatcacaaggctgagtggaatgtaggagaaggtgatcgagaattgatcacttgaccctccctctgacatggacgtcaaaatagctgggatgattaaattgaccgcgaaactaatgatatatgagatgataattccgatgatcgacccaatcaccccaatataagcactttccatgaggaacattcgcttaataatggatggattcgcgccaatggctttcataatcccaatttcttgtgtccgctctgttacagccattgtcatcgtattgaaaatcccgatcgcagaaataatgaccgcaatacatccaacaaaaataagtccaattttgaagactgtaaagaacatatccattccttcgagctgattcgtcacagagatgacttggtagccctcatctgtcagcttattcgtaagcgcaccaacattgtcgaatttatctgcatagacagaggtcattttctcgacatttcctgcttcaggagatagatcgagtatttgaccaaattctttttcatacgcattcggaatgagaattttatgatcctcctgccactccagatttggctttttcataacacctactacacggaaatcaaatgttttttctttgacgacttcattttcttcatttaattttggcactttgatttgaatcactttatttaaaatatccttcgtgtagcctttaggctcttttggcatttcttcaccatttgatgtctgatttaattctttttcataggcttcgcgttctttttttgtccacagttgttcagccatatgatacccgaccacaatttcgttcgctgatgttgggactttacctcggtctagctcaagccctgcttctttttcttctttcatatcggtcaaagcaacctgcgtttcacctgagcggtcatcgagctcgatctttaccgatggagtgagcgccgttcttgaaaccacagatttcacatgatcatatttcttcaaatcatctgtcttgacgtcacctttttccttgcctaacactttcacttctgtgatgatttgctgtttcatgatttcatcttgcgctgatttttgcagaccaaaaccgacagatgctaaaacgattaagaaagagcatgccattgtcgtcgcaagaatggtcataaacacacgcaatctatttttcttcatgtttcttctaatgaatttgacctgatctctaaacttcaatggattgttcccctttctttaatacaccatcatggagctggaacgttgtatctgcgatggaggcgacttcatcgtcatgtgtaataatgacaaatgtgattcctttttcacgattgagctgctggataaaggctaagatttctccttcggtttctgaatctagactgcctgttggttcatccgctaaaataatagatggatttaaaatcaaggctcttgcaatactcacacgctgttgctgcccgcccgacaactcattcggataatgccctgcatgatgttctagacctactcgtttcagcatttcttttactttcgcctttcgttcagacggctttacaccttttaaagtgagcggaagttcaacattctcatacgtcgttaagctcccgatcaattgaaagctttgaaagataaaaccaaagtgatctaagcggaagtccgcccattctttttcattaaatccagtcacatcggtaccatcaatgacaatttgtccgctcgctggcgtaatatatcctgaaattaaattcaatagggtagatttccccgagccacttcgccccactatacaagcaatgtcgcctcttttgatagacaggtctatccctttcagcacaggaatctcattctctctgccctttttaccaattttaaacacatgatctaacgcttgaatctgaatcatctctactcccctgctctctgtttatctttttcgatatattaagaaataacttgttaatgcacctactacgccgccgatgatcatgccaacaatataacccaatatggaagtgtcagaagaaaatccaacccatccaaatcctagaacaccgaagacaatgaccaaaatctgaatcggtctatccatttttgagtaaaggaagaaacgaccatttcgttcaataggatgcttcataaagctaagcaaaccaatgagataaaatacaatcatcatcacaatgggtataatgaattcttcaccactgaaccaaagtggatatttatctatatctcgaaattgaaaacggtctgttatataagtaattggggcgataggcataataaagtattcataactgacatcgacccaatgcctattcgttcttaaaataaaatctaaatgaaacatcggaagccaaattaataaatatggcaatatcgctgtactgaatgtaacaatggcttgactaattgcgcttcctgttaacgcacctgctgcaagacacaaactataaatcattaaggttgatacgagtgcaatgaagtaaccactattaaagtcaaacgtctcttttggttgagtgcctaatatgagtaagtaagtgaggaaatatgacaacacatgaacaagcgttatgattccggcacctaagaaaaactttgtatgataaatggtacttctgctaaacggcaaggataaagtaaaatcaatttgtcctttatttctttcatatcccagctggataatcgcaaaaagcaagcccataagccatgagagggcgataaaaatatcagaactgaaattataataaaagtattgatctccgattgtacatgtggggtcgtttacacaagtttgaaaggacgagtatcccagtaaaaaggataatggcgtcgtaaagactgcaaccagcatcactaaaataaatgtcagctctgattgcttccactctttatataataattgccgctttaccatctccgtttccctccaaactttgcaatgaatacttcttctaaattcacaggcagttcatgccatacttttggctgcagcgacttcaagtactctttagcctctacatcggttttaagaacaagcgctgtataaaaaatgcccgcttgatctaatatagcaacaccattttttcgtatactcaagttcatatcttcttcaaaggccatctggattttgacataatcattctttaattcatctagatccatgacacttgtgagttgatttccttctaaaaacccgattcggttacacatccgctcaatatcctctaatcggtgcgatgtgatgagaatcgacgtttcacgttccgctacctcgtcgatcatgagctgaagaacatcatttcttgtgacggcatcaataccatctgtcggttcatctaacagaatcacggctggcttgatcgcaaagcttaaaattaatgacagctgtttttttaaccctgtcgatagttcgcggtattttactttttccggaatttcatagcgattcacaagctcattggcatatgtcacgtcaaacttcggataaatatgctttaacagctggacaagctgcccgtaattgtatctgtcaaagtaaggattgacgactggcatatacacaatattttgcttcactaacgggtggtctttcacaagcacgtctttaaaataaatctctccttcatctggaagaagaatttgctgaatcaagcggagaagagttgttttaccagagccattcctgccaagcaaaccaaagatttcaccttcgcctaatttgaaggaaacgttactgagtacttcacgtccgtttaatgtcttcgatacatttctaacctcaatcaactttttttcctccctcaagacttgagccgatctcttctatccattccttcagttgttgaatatcaataccggcataatgagcttctataatgagttgtcttaactgctccttcatctccaataccttcccttcattcagctttaactgagcctcttctgttacatacgtaccgcggcctcttagtgtttcaataatcccttcccgctcaagctccttatatgctttactgacggtgtttggattggcgatgataatagtggcgagctctctgacagagggcagtttgtcaccaggtttcattacaccttttagacataaaattttgagttgctcaatgatttgttcatatattggcgcagcgcttcgtggatctatttgaatcatgatggctccctctttcctcattcatgcttttgcagtcctattgcttgttcatgcccttgcattaaagggattgaattaagtatcaaatctttttgaacttcaaaaccaatgaaaacgagaacgaaaaaaaatgtacatgctaacaaaacagccagcaccatccactttaaattgattggttttttttcttttttcatggttgaacacctttcttcactttttaagtgcctttagtgtattagttgatgtagtacacttaatacaatatagacactcaaataaaaagtcaatagcctttcaaaaaataaaaaacagacccttaaaaaaggatctgttcatcattcgttgtcgtaagaaatacctaaaatcatttgattttgtaagctttgaatttgaacacgtgctctgtctaaccgctctctttgctggtcattggcgacatcctttaatttttctaattcgttcaccgcatcttccagcataagctgcgccttagaaaattcatcctcattataatgctcttgacgtaagttcaaatcaaattgctcatttgcaaactcaagggtttcagtacttttttggataaattcatcgattgactgccttgttgccatcctgcattccctccatttcatcatcgctcccgcctattttgcccacgtaaagctttttcactaaagaaaatgttggacagattcaattgtcctccttcatgatttttgttaaactttaaggatgcctattattacgcaaggaggttactgacttggatcagcataacccttttttatattcaaacagcgaaaaacgctatcacacatggaactatcatttgcgagaacactttggtcataaagtatttaaagtggccttagatggcggctttgactgcccaaaccgtgatggtactgtagcccatggaggctgtacattttgcagtgccgcaggatctggtgactttgcaggaaaccgggcggatgatcttgtcactcaatttaacgaaatcaaagaccggatgcatacaaaatggaaagacggaaaatatatggcgtattttcaggcgtatacaaacacacacgccccgcttcctgttttaaaggaaaaatttgaaaccgtgatgaatttggatggtgtggttggtttatctattgcgacaagacctgactgcctgccagatgacgtggtggagtacttagctgaattaaatgagcgtacttatctttgggtagagcttggtcttcaaacggttcatgaacggacagctatgcttattaaccgtgcccatgattatgaatgctacgtagaaggtgtagaaaaactgcgaaaacacggaattcgtgtctgctcgcatatcatcaacggcttgcctcttgaaaaccgtgacatgatgatggagacagcaaaagctgttgctgatttagatgtgcaaggaattaaaattcatttgcttcaccttttaaaaggaaccccaatggtcaagcaatacgaaaaaggcaaattggagtttctcagccaggaggaatatgtccagcttgtttgtgatcagctggagatcctgccgccagaaatgattattcatcgtattacaggggatggcccgattgaattaatggttggtccaatgtggagtgtaaacaagtgggaagtattaaatgccattaatgctgagcttgaaagacgtaacagctaccaaggcaaacgtttcgtcagattggaagaagcagcaaaatgatcttgaaacgcatgctcccttttagtaaagagctattagaacgggcttgtcaaaaaggcgatgttgtcattgatgcaacgatgggaaatggccacgatacactctatttagctgatcttgtcggtcatgatggacaagttttcgcattcgacgttcaagaagaagccatactgcacacacgcaaaaggcttggcgagggatatccttatgttcacctgattcacgatggtcatgaaaaactggctcaacacctgccaagagatgtttatggatatatctcaggtgcggtgtttaaccttgggtacttgcccggaggcgataaagccgttaccactcaggcccatacaaccattgaagccattgagcagctcctcaactggcttaaacccgggggtctgatcgtccttgtgatttatcatggacaccccgaagggaaaagagaaaaagaagtacttctcgactattgcagatcacttcctcatgaagaggtgcaagttttatcatatcaatacatgaatattcaaaacgacccgccttttgtggtcgccattgaaaaaaagctcaaatcctaatggatttgagcttttttatgaggatttcatccaaggcattttctgataggtccggtaagctcttccgttgatatagaaaaagaacgatgttttcccgcttgatctgatcagccgttttgccagcttattcatctctttttgggctgttactttttcatcggacaaatagactgccaataatcctctgttaatcaatttgtgaaagttttcgtgcggaatgcctttcagctgctcatccgctttttcaataaaatgctgaagtctatccatcatctcatgatgagaagcatagtaggagcaaaagttcagatctcccccaagcctatcttcttcttggtcaattaaataatcaagtaaaatgtgcagaccttgaatataagggaaatagctttcgtaaatttgcttcgcctgcttttctgtaaagttcggctgcagcgcgtacgccacaagacagaaaatccctaacgttgatcctgcacaagctgaaaattcataccattccatcttaggtaaatccttttcatattggcggaaccacgattctagccgcggcacacgctcatgaggaacgacgtgtttatgtacttgcaaatcactgtagtaatcgcacagcgtgtgtaaatatggctgaatgatcggataatgcttaaggcgcgacagcacgtcttggcatgtgcggacaagcgcgtgtaaatacccatgatcctcttgatcatcacggaattggtagtagggtttgagctcagcatgaatatcaagcgcatctctcattgcttgatgcagcatatgaaaatcttttggatcaagcgacgtactgcggtcacataggttatctaagtaatcactgatggtttgatacgccacaatgaattcaatacatgtttctttcgcctcacctgctagaagagataaaatgcctccgccttcgcagtgaaaggttttacttgatatgctcgctaatgcctgcgtacgcagttcttcattttcaatcatttctgcatgagcccgccactttttcagctcctgatgcacaagcggaaaaatatctttatacaccttggtcatcagtgcaaaaggacgctctggtactgacaaatcaatccacccctaacttaaagctcaccatcaaatatattgatctgtaaaggctcttgctgccttaaacacatcttctctttccggttcattaaaaatttcgtgatacaggtcttcccattcacgatatgacttattggttgattcaatgccattgaaccatttgatcaccctcgttttatcgacaatcttatcatcgcccgcctgcattaaaaggagcggaatcgatttaaagacattcgttggctgcatggccgcatcaatatttttgatcagctctcggtaccagcgaaccgacacttttgttacgtaaagggaatcatttgagtctgcctcaatcacagcctgatttcgtgtggctagttcaatcgacagtcctgactcgactttaaaagacggtgccagcacatttagaccttttgatgcaaaatccattagcttcttcggtttaaattgcagacctaaacaaggtgatgataaaataaggccatcaatcttcgtatgggtatactgcttgacccactcaattgaaacgagtccgcccatactgtgaccaagtaaaaaagtaggaagcctgaatgatttcgcatgttcaatccattcatctactgtatcaatgtattcttgaaacgaacgaatgtggccgcgcgcacgtgtcgatgtcccttgcccaggcaggtcacccatgatgacgtgatagccggcatttcgccacatttcgatcagccatttatagcggccgtgatattcgctcgcaccatgtacaatcacaattgtaccaactggtctttcagcatgccaagtccacaaagtaaacacctcacaaatgttgtattaagaagggaagtcgaaaaagtgatttatccatatcatcagtttacacctgagattcacgaatcggtctttgtcgcagaaaacgccaccattactggagatgtcacgattggagaatattcaagcgtttggttccaaacggtcattagaggcgatgtcgctcctgtgagaattggaaaaaatgtcaatattcaagatttatcctgtctgcatcaaagtcctggaaaaacacttcttatagaagatggtgctaccattggacaccaagtcacattacatagctcaatcattcgaaaaaatgccctcataggtatggggtctatcattctcgatggtgcagaaattggcgaaggtgcctttatcggtgcaggtagtcttgtccctcaaggaaaggttattccaaaaggatcactcgcttttggccgtccagccaaggtcgtccgtcaattaacagatgaagatatccaagacatggacagaatccgtagagaatatgtagaaaaaggacaatactatcgttcccttatatcccgttaacatcatacgcgtatcttcactttatcatgtttttttcaggatattaagcaataactatgaaccgcttgttattttacccttttccaccgctttctatcatgacaaaaaaggttttcagcacaaagctgaaaaccttttttattaactaaagatgacttctttcggttggtgattcaactgctctggatcaatgctgcgctctacataaatgctgtgccaaatcataaagataaggacggtccaaatcttacggctatgatctgctttaccagcacaatgctcatttaataaatcaagcacatactctttgttaatgtattcatctgtttgactgtttttgatgatgtctttcgcccaagcattcatctcatttttcagccaatgacgaattggcacagggaaaccaagctttttacggtttaacacgtggtcaggcacaatgccttctgctgctttacgcaataaatatttcgttgtgccatcttttgttttcagctcttctggaattttagaagccgcttcaaaaacgaccttatcaaggaatggaacacgaagctcaagagaattcgccatcgtcatcttgtctgctttcaataagatgtctccgcgcatccacgtatggatatcaacatattgcattttgttaatatcactgtagcctgcgctttcctcaaagtatgtcttcgttacgtcacgatacgtgatgcttggatcataatgctttaagaggtttttcttcactggctcttcaaagattttcgcattaccgatataacgttcctctaatggcgtacagccgcgaacgataaagctcttccctttcattccttctggcattaaacgagccagacgaagaagaagctttttcagcatagatggaacagattcaaatggtttaagagaaagaggctcacggtaaatattatatccaccgaacagctcgtccgctccttcacctgaaagaacaaccgtcacttgtttcttcgcttcttttgccacgaaatacaatggaatcgccgccggatcagctaatggatcgtctaaatgccagacaatcttcggaagctcattcatatattcctctggagaaataacggcgctgaagttttgtaagcctagcttatcagctgtttccttcgcaacatcaacttcactaaagccatcctgctggaaaccaacagagaatgtctttagctcagggtgcaattcctttgcgacagacacaatgaaggaagaatcaataccacctgagaggaatgaaccaacaggtacatcacttctcatgtgaactttcacagaatcatagatggcatcgcgtacttcttcaattaacttctgttcttgtgtttgctcaggcttgaattgaactttccagtatgtcttaaattcgatctcctgtcctgggcgtaaaataaactgatgaccaggctcaactttatgcaccttttgatcaagcgtatttggctcaggaacgaattggaaggacatatactgctgcaatgaagtctcatcaaataaaatgttctcgttcacagccatcaaacttttgcgctcagacgcaaagtacacttgctcatccatttgtgtaaaataaagcggtttgatgccaaaaggatctcttgcgccatataattgctgcgcttctttgtcccaaattaaaaaggcaaacatgccgcgaagcttagaagccgcctcttctttataatgacggtatgtggcaagcagtacttccgtatcagaatctgtgctgaacgtatagccctttttcacaagctcttccttcagctccacatagttataaatttctccgttaaaaataatccaatacttttcatcttcataagaaagcggctgctttccatgctcaacatctataatacttaaacgtctaaatccaaatcctacatgctcatcatgaaagtaaccctcatcatccggaccacggtgaacgatgagacgattcatttgtttaattaactcttcctgctcagtagtttcggacaatggacggtgattaaacacaccaacaaacccacacatattattgcctccacgttatgttatttcttaaaagtagacctataattagacagttatttgtccgattttgtttcacattttttcgctttttgtagaattttttttaatcaaaaggaaaaccgcttaaaataagcggttttatatgttgttattgtcctaatgcttctttacgaagtgtatcggccttatccgttttttcccacggaagatctaaatcatgacggccgaaatgtccgtatgcagctgtttgtttgtagatcggacgacgcaggtcaagcattttaataatgccagctggacgaagatcaaagttcgcacgaaccacttcaattaatttttcttcagaagcttttcctgttccgaaagtatcaattgaaatcgagacaggctgtgcaacaccaattgcataagcaagttgtacttcacaagaatcagcaaggcctgcagctacgatatttttcgctacgtaacgagcagcgtatgccgctgaacggtcaacctttgttgcgtccttcccagagaaagcaccgccgccatgacgagcgtatccgccatacgtatcaacgatgattttacgtccagttaaaccagcatccccttgaggtccaccgatcacgaaacgaccagttgggttaataaagtattttgtctgttcatcaattagttcacttggaacgacagggttgatgacatgctcttttaagtcgctttgaatttgttcaagcgtcacttctggtgcatgctgtgtagaaataaccactgtatcaatacgaacaggtttattttgatcatcatattctactgttacttgtgtttttccatctggacgtagataagcaagtgtttgatccttgcgaacttcagttaaacgaagagataatttatgcgctagtgaaatcggaagcggcataagttcttcggtttcgttgttggcaaaaccaaacatcaatccttggtcacctgcaccgatcgcatcaagttcttcttcagtcattgtgccttcacgtgcttcaagcgctttgtctacaccttgcgcaatatcagcagactgttcatcaatggatgtgagcactgcacatgtttccgcatcaaaaccatatttcgcacgtgtgtagccaatttccttaatcgtgtcacgcaccgtctttggaatatcgacataagtagacgttgtaatttctccgcttactaatacgagacccgttgtaacagaagtttcacaggcaacacgtgcatttggatctttctttaaaatttcatccaaaatgctgtctgaaatttgatcacagattttatccggatgtccttccgtcactgattctgaagtaaataaacgacgattttgactcataatggctatttcctcctgtacaagaccacatcatcccaagatgaggtctccaatatgatacggaactcgttccctcttatatttgaaaacgtttctattagagatgttattggcaatttgttcatatgatatcccaaaaataaaaaaaccatttccttcattgcgaggaaagggtctgagatcgcatgcctttcactcttatcgctcaaggtgttcttgtaccttgcatcaggttagcaccttggtttctcagcatattcatgccttttcataagaaaccggttgctgggcttcatcgggcctgtccctccaccaactcgggataagagtatccgttcaataagatatcttatcttaaacacttgcgtcatgtcaatgcttcatcagaattatctcccctttttttcacctcaatattagcatcaccaaaaagcatattttcatagcagaaatgaaaaaacacacacaaaaatatttaaatagtatagactattcttatgaatgtgttatactaatcgaaacaaaacaaattcaacggtaaaggaagggtttttttatgaactcagtggatttaaaagaagatttgcagtcattgctctcattagaaaatacgcaccaaaatttatctgttccgaaacttgttgaaaagattttggcacgtgatgaaggcgttttaacatcaacaggagctgtccgtgctacaacgggtgcctacacaggacgttcgcctaaagataaatttatcgtgaaagaagaaagctctgaacataaaattgattggggtcaagtcaaccagccgatttctaaagaagcatttgaccgtttatatacaaaagttgtgtcatacttaaaagaacgtgatgaactattcgtctttgaaggatttgccggcgcagatgaaagataccgtatgccaattacagtggtaaacgaatttgcatggcacaatctctttgcaaaacagctattcatcagacctgacggatcaacaccttcttcaaacgaaaaacctttcaccatcttatctgcaccgcattttaaagcagatcctgaaacagatggcacaaactctgaaacgtttattatcgtttcttttgaaaaacgcaccattctgatcggtggaacagaatatgctggagagatgaaaaagtccattttctctgtcatgaactacctgcttcctgagcaagatattttatctatgcactgctcagcaaacgttggtcaagaaggcgatgtcgcactattcttcggcctttcaggtactgggaaaacgacgctttccgcaagcgcaagccgcaagctgatcggtgacgatgaacatggctggtctggctcaggagtcttcaatattgagggcggatgctatgcgaaatgtgtgaacttaagcgaagaaaaagaaccgcaaatctacaaagccatcagcttcggatcagttcttgaaaatgttgtacttgatgaagaaacacgtgaagcggattatgatgacacattctttactgaaaacacacgagctgcttacccaatcgaaatgattgataacatcgtaaagccaagtatcgcaggacacccatctgccattgtcttcttaacagctgatgcatttggcgttttacctccaatcagccgtttaacaaaagaacaggcgatgtaccatttcttgagcggttacacaagtaaattagcaggaactgagcgcggtgtcacatcaccagaaacgacattctctacttgcttcggttcaccattcttgccgcttccagctcacgtctatgctgaaatgcttggcaagaaaattgatgagcacggcgctaaagtattccttgtgaatacaggctggactggcggaggctatggtacaggcaaacgtatgaacctagcgcatacaagagcaatggtgcaagcagcgatcgaaggcgacctcgacaacgccgaaatgatcactgatgacatctttggattacacatcccgcttcatattcctggcgttccagatgaagtgcttcaaccatctaaaacatgggatgaccaagaggcttatcaagaaaaagcacacttccttgccaatgaatttaaaaagaacttccaaaaattcagccacgcagcaagtgacattgaagccaaaggcgggccactcgtataatcaaatgacaaaagctgaggggaatgattccctcagcttttttggttagtttgttgaatgtaatgagacgagacgataagtgacctttgtcacattgtctgtaagctcaagcttttcaacgtgtgctgtccctgttttttctccgtctttcgttttacgtacctcaagcggaatatttaatggataaatgcggtatccttccttcatgagttcaaatacattctcttcaattcttgtctcttttcccttcgtgacaatcattgtattaaattcaacaggcattcccatattgaaaatccccctactttctaaatttcattatactgcttattttaccacatttccgcttttccggctgtgcatccacgtcgtcagccttctgacaatttcccgattatgctgtggcggaaaataatggttgtatccatgaaaataccaagtctccactgactttccgtgctggcgcagcgcatcttctaataaatacgcatgctcaatggatacattctgatcctcttctccgtggatgatgagaacaggcgcttcaattttgtccacatcgtttaaaggcgttctatcctcataagcctctggcaccttgtgagggggaccgccaatcacacgtttcatcatccttctcatatccacacgttcttcataggtgagcttcatatcactgacacctccccatgtcacaaatgaagccgcctcttgcttcatttcgacagcggtccaaatgcccataatgcctccgcgtgaaaaaccaaagatatgaatacgatcctgcttcacctttttgtgatgctttaacaattgaaaggcagcaaaagcatctttccggtcctctccagcaaagtcttcgttcccttcgcctccttgatttcctctgtaaaagggcgcaaatacgacaaatccctgtgcggcaaattgcacaatccggcctggtctcaccattcccacattttttatgccgcctcttaaatacaaaaagccgtcataacgaccttcttcggccggttcagcgagcaatcctttgatccgaagtccatctgcctcataggtcactgtaaataagtgaatatgcggatggggggacggaaaccttcttttttccacaatcacttgatttctctccttttcatctgttcttacgtcaattgcttgatgattgcttctgcgacaagctgacccgatttagtcaccattggcgtgcctccgcctggatgacttgttcctccaacaaaccaaagtccttcaatgtcctttgactgattattgatacggaagaacgcctgcttgaacgagttggaagacataccataaatggctccatgatatgcgcccgttttctgctgcagatcaagcggagtttgaaccgcttcatattcggccaccttgtccaaatcaaagagacccttttcctttaattttgttttcacatgctgcgagtatgtctctcttagcatgtcccaatcttgctcttttgtcacagaaggcgcattcgccaggacaaacaagttgcttcttcccggtcctccgcttaaagctggttctgaatgacctgaataacatatgtaaagtgtcggatcctgaggcagttgttttttctgaaaaatatccttgaattcttgctcataattctctgggaaaaacacattgtgatgggacagctgttcatagaccttaggtacacctaataagagaacaaagccagataatgacggttcaatggcagcaagcttttgatttaaaaagcttgggcggtctttttcatcaatcagatggcggtagacagtcagcgcatccgctcctgcaatgacttgatcagcttcatacatctggagagccgtttctactcctttgattcgccggtccttcacatgaatcttgttgacttgttcattcaggtgaatctgtacacctaattcctttgccaaagtctcaaatgcttcaactaaacgatatgtaccgccctttatgccataaattcctttctccccttctaaatacgccatcatattaaaaatagccggtgcctcatagggagaagagccgatgtatgtcgcataccgtccaaacatcgccaatgtatgcggatgacggaaatattgtcgcagcaagcgttgaacggttgtaaacggtttgacagagagaagtgctttcacgagctttacatccgccttatccttccacgtcaataacaaacgatttaaaaactgatcctcagccagttcaaaaagcatctttgattcctgtaaaaatgcacggtattgcttcgcatcttcaggactgaatgctgcaatttgtgattccatctgctcaatattcggtgtaaattcaaccgtatgtccatctgaaaaaacatttttggtcaggggagagatcggataaaatgtgacgtaatcctccatccgtctatgacaggaagcaaatacttcctcaaagtatgacttcattgtaatggtactcggtcctagatcaaaagaatagccagcctcctgatggcgctgcaatttcccgcctaaagccgcttctttttctaatatggtgacctgaaccccgcgtgactgtaagcggatcgctgctgataatccgccaagcccgccgccgatgatgatcacttttttcattcgtaccttctccctttccattcatacccttcttttttcagcccgattttcatagaagcaaagccaatggcgatcagactcaaaatgctgaccggtaataaaaaggccattgcagatgttcttccgttctcaatatcaattgccgctttgatcgacacacctagtccataacaaagaatcgctaagcatatactcagcacatccagctgcatcaaagccatcatcaaacaaatgacaggagccaaataaagcagggtgtataaacaaaagacactgcttaacaaagcaatgcttcgattgacacctgggaataaatttttccggtagccttcccaaacctcttgtccactctcatacattctcatatacacaaatggatgaatgcttgctagtgtgaacggaaagccttgttccttcacccgtttagccaatgccatatcatccactagcgaatccttaatcgcttcatgcccgccgatgtcgtgatagcaattcttttcaatggcaataaagcctccatgcgcggcggcaaaagctggattctttgattttctgacccacttcacaggcagatgacagccaatggtaaacatcatcatgggaacgacaagatgctcaaaaaatgtacctgttttttgttcggggaagcctgacagcatgcccgttttttgcgtgcataactgctcatgcacagcttcaattgctccccgtttcaaccggacatccgcatctaaaaataacagccaatcagaagccgttgcctcagcaagctgagaacaagcgtatgatttccctaaccagccttgctttaatacccggcctgactgcacacgaatccatggatatgtttgtgagaagcgctccacaatcgctcttgtctgatctgtcgaatgatcatcaagtacaacaacctctttcggataaagacgttgatcaacgatcgactgaagacaggcttctatccgtttctcctcatttctagccggaatcagtatcgataacgaaatacgttcatctggcgaaaaggaagcgggctttaacacgggaaactgcttcatattccatatcgtaaatagaaactgacaaagcagcagcacactgatcacagttaagaagagcgccatgttctcacccactttttaaaagaatcaaacgcatcacttgttgactgacttgtccttgtgacctgtctaaattcttcgtttattgaaaaatcaggatctgcaatgatctgtgattgatgtctgtttaactgcgtttcaagcagatcgccaagcatacgcgtcatatccttgcttcgcagggagcttccagatacgatggcatcatcaccgaacacaacagaaactatcggcttttgatattgattaaatgtatactgcaaggttacaggcttcaccacgacttgttcaaattgtctcactaaaaaagaagccccgccttccagttcaagcggtctcacgtcctgatgcataattttcccctgtggaaaaagccataccgctccgccgttctgcatgttctcttttgctgtcattaaagcttgcttcacgcttctgagattctctttatgaaccggaaacgccccaagcttacggaaaaaagcatattgcttcagctgcttctcttccatcatcatgtagtgattaagctcagacgctttttctgttaaaagaaaaatgattaatccatcccaccatgagctatgattggcgagataaagaacaggcaggtttctcttcgggtccaccgagcctttcatcatgacacagcggaaatgcttatggagtaaatatcgctcaagataaagtgaaaatagacgtctaaacgatcggcttttgtcgctttctttcaaatcgaacccttccttcacacaaaatgacaatgatcagtgctaaataaaaaatgacatcgagtccgccctttaatgccaaaagaccaaaaaagaacaccatcgcctgataaatgcggctcgtccagctgagtgccttttgatcaattgagacaagcgggaaaagaaatgaaagacctgctccaatcataccccagcttacaaaattctcaaaaggaataccataaaacccaccgccgtcataccatacccaaaacctccgctcagctgctactggatctaatatgaggtcaagcaacacaatccatatccccgtttcgacggctcgtctccactttgactgctgactggataaaaaaaggctgtttaaaaacacgccaacccaagcaaacgcaatagttaacggcacccccgccactagaaagcctagcgtcggataatagtcataggccccaaacggaaatcccgttgtgatccctatccactccaccgtaaatgtaagcactccgacaatggctgcccttttgatgacaaacccccatgagccataaatctgtcgcccaatctcgatgacgcagcaagcatacagtacaagaaagattccgtttgcaaactgaagccatgctggcacttcaaaaaagaccattaagatcagacctactacataccatccaacaaatacccaactcaatctatacacgaaaccgctcctttatttctgccaaattcaagaaagccttcatgcctctagtatagaaaaaaagacgcgttctataaataaacaatgcgcttcttattttcgtctaggcactcaccaaaaatcccttttcacatactttaatagtgatctagaacaaaggaggcgaattactcttgaatcgttccatcaaagtcagactggcattcatcgtcgtcgtcctgctctttattccatttgtcgcctgtaaaaaagaacaagagcagaccgtacaagtagccgaggtgacccattcggtcttttatgctccgttatatgtcgccttatcaaaggatttcttcaaagaagaaggcctagaggttgaactgaaaactacttggggcggcgataaaacgatgacagctctcttatcaggcggtgctgatatcgccttgaccgggtctgaatcctctatctatgtagaggctcaagacacaaaggattctgtcatgaactttgcacagctgacacaaacagacggcacatttcttgtttcaagggagaaagtaaaccagttctcttgggatcaattgaaaggaaaagacttcttaggacagcggaaaggcggcatgccgcaaatggtcggtgaatatgtcttgaaaaaagaaggtattgatgtaaaaaaggatcttcgtatgattcaaaatattgattttgccaacatttcaggtgcgttctcctctggaactggcgattttgtgcagttattcgaaccgaccgcttccttactcgaaaaagaaggtaaagggtacattaccgcctcctttggagaagcatctggcaaggtaccatataccaccttcatggcaaagaagagttacttagaggaaaacaaagagaccgccgaagccttcacccgagccatttacaaagcgcagaaatgggtagaaaccaagcagcctgaggagatcgcaaaggccattcaatctcattttcctgatacagatcttgctgtcttatcaactgccatcaaacgctacaaacaacaagattcctatgcaacagatcctcttctaaatgaagaggaatggaacaaattgcaggaaatcatgaaggagagcggagaattgccggaatttatcccgtacaaacaacttgtcgattcatccattgcaaagaaggtcacagatcacaaatagaataggaggtagcacatgtctttccttcaaattgaccatgtgacccatacgtacttctctttaaaagaaaaaacaacggctatacagcacatcaatatggagatagaccaaggtgaattcatctcatttattggtcccagcggctgcggaaaaaccaccttgctgtctatcatcgcaggaattacaccgccctctgaaggtcgaattttaatcgaaggaaaagaaccaaatcaacaggagcatcaaatcggctacatgctccagcaagattatttatttccttggaagaccatcaaggaaaatgtgattctcgggttaaaaattgcgaaacaagatccacatgagtccgtctcagctgcccttgatttactgccaaagcttggactgcatgaagtcgaggaaaaatatccgaaggagctgtctggcggaatgaggcagcgtgcggctctcgcccgaacgcttgcagttgatcccggtctgcttttactagatgagccattttcagccctagactaccaaaccaaactcacattagaagatctcgtctttcacacattaaaagactatcaaaaaacagcagtccttgtgacacatgacatcggtgaagccattgcaatgagtgaccgcattttcttattctcaaagcatccaggctctatccagcgaatctttaccgttccagacgacataagggctctctctccttttgaagcgagacagaccccgcatttccaagagctctttcaaacgatttggaaggagctgaaaacagttgaaacacagtgaccttttacatgaagcctatcgcaaaaaataccgaatggaaaaacggatcacacgtatctatcagctcatcatattcgccagcttcttttcgctttgggagcttgccagtcatttcagattcattgatccgctcattttcagttcaccatctgcggtctgccatttgtttgtgcaaaaaattcaagatggttctttaatgaatcatatgagtattacattatttgaaacggtgctcggttttctacttggtaccttttgcggcattttgctcgctgccgccttatggtggtctactcgattagcaaacgttcttgacccttatttagtcattttaaatgccatgccgaaagttgccctcgcccccattttaattgttgcccttggacctggtatgatcagcatcgtcgccatgggtgcgatcattagtgtgatcattacgacgatcgtcatttacactgcctttcaagaggtcgatgagaattatttaaaggtgatgaaaacctttggcgcgaacaaaagcgtcgtctttcgtgaggtcattttgccagctagtattccaacgatgatttctgccatcaaagtgaatgtcggtctttcttgggttggagtcattgtaggggaatttcttgtatcctcaaaagggctcggctacatgattatttacggctttcaagtcttcaactttacactcgtgttcttaagtcttttcattattgctgtgtttgcgaccatcatgtaccagcttgtggaatggctcgaacgccgttttctccaaaaataaaaaaagcacagggagatctccctgcgctttttttaacgaatcaaaccgttcttttctaaataagcaagactttgtcttaacacatcatctttcataataaaactgaaattcttattttttgcgatggatcttggcaagtctgcgaaaagaacaggtccttttgtttcaaaatacgtgtcttgcttcactagcctttcaatatcagcgaaataaatattttttacgatgaccttttctctgcctagcacctgatattggccaatatacgttaattcacgaacaacagcacccgtctcttcttgaatctcacgtatagcggcttgatccgcttcttcatttggctcaactttccctcctggaaactcatagccccgatcctcatgttcagtgagcagccatttcccctggtaacggcatatggcccagacatgctttggatgacttgaaaaaggcttctcttcaaaggagagcttgaccgtattatgataatagtctttaaatacatgcatgtgaaatccctcatatcctgtccttgcttcttgtaaaacatcataccacagatcacatttctctgaagaatttttatcaaaagtgaaacaaacgagtggtttcatttcgtctgtatttaatataaggtattgttgctaaaacctttttatcatccccaacttcaccctattttaatcatgaaaccttttatcccttgatgacgtaaatcaatgagtgtttgtcctattacgacgaggaggaaaacagcatgaggataacaaatgggtcaaaacaagagaaagaccaagcgcttacacccagtaaaatcaaaaaagaagacgcacctcatgaggtgatcaacaaacacctcatcaaagggcaaaagctagatttaacaaaagacaatccaaatatcgaccaaattcaaatcgggcttggctggtatttggctggccagccaattgatttagatacgcaagtgtttctcttaaatgaagaggacaaactgttgtctccaagccatctgatctattatcatcagcagcaaagcttagacggagctgttcgccatcttggtgatcatcaagttggcggcgggtatcgagacaatgaaatgatcattatgcaattaagcagagtctctcctgatattcataaaatcgttgttacagctacgatacatgatgcacacgagcgcaagcatcattttggacaagtgacgaacgcttacgtgcatctgactgatcaaatctcacaacaagagatttgtacctttcaattaacagaagattattcgtattgtacctccatcatttgcgctcaactcataagagatgaggaagaatggaaaatcatcgcaaccgggcaaggaactacgctagatttaaatgatttatgccgcatctacggattcacatcttgacgcagaaaggagccggcaccaatgggatttcatttcaccacaatagaagaacttactttacaagcagaaggcagcggaatcttttttgcgaaaaaaggcgcaatgattgccgatcaaggtacgtttcaataccgtaaacgactcctcggaacaaacaaaggaaatatggtcagtcaagtatttaaccatatcagcaggaaattgacaggtgaaaaccttgaagtgatggaggtcagtggacaaggtacttgttatttagctgattccagcgagcacgtgacagtgattaatcttgagccgagcggtccttggcagcatgtaagtgtagaaagtgaggatttacttgcctttactgaggaatgtcattacggcgtgacaccagtaggcgtagggattttatcacagaaaggactgtttacatcaaagctctcctatcaaggccacggggcgcaggtcgccattaaaacaaatggaaacccgctcattttaaaagccccttgccgtgtagatcctgacgccattgtcgcttggactggtaaagcaccgaaggtcaaattagatgtgaactggaagaccctcatcggacaaacatctggtgaatcctacttatttgagttccaagaacaagaccaaattgtcattatccagccatctgagcggacatccggcttacgggttggtttagatgataaccgttacaagcctcagagccagagctcctctcatgaattcacgaattcacagacatctcagcaagagaatagaagcgggcttagtgacctgatcggaggcatcttacaaccgcgaaaataaaagcatgtagaaaatctctacatgctttttcaattcattaatccatttgtttcaataaagttctttgtctcttcatttccgagctcgaaaatcattgagtatatctcttttctttttcgatccatttcatcattcggactgtcataatgatattcaagatacggaacatgcgctcgaaagaagcctttccaatctgtcatatactgttcatcgaaatagtctctcagctgcaaaatttgatcatcgtctgcttctatttgaaattgccaagccgcagcatctctatgctgcgatatcgatccatcctgtacggatacataatatgtgtgtctcgtcatctgattcatcctttttcctttagtatgaccagatatgaagaaattacggcttcttgcgcaatttattttttaacatgtccaacacatcaataaacaactgtggaatgggaattccgagggcattggctgtcgagacgatttggtaagattcataaataatataaaagatgatcgctaaatccttaatcatcccatttgtcttcagcatgacatcgaagaaatgcgccatggatattagagagaccgtcacaatctttcgaacaagccgcgtagaaaaacgtttcattgtgagctgtcctgtcaaagattctcttaggcttgaacaaattaattcaatggccatgagtgatactaatatcatcagtaaatatcctgctccaccaaacagaaagcccatcgctgacaaactgactgtaaacaacgaaaagatgcctaaatccttgctcacttggcatcaacatcctttcaaagtggaactccttacctcaatagtatatgccagatcttcgcaatagcttggacgacaaaaaataaaggcgtcgccttttcaatcagacagagtgatgacaagaaaaaaagccgccttatgtggcggcttccatctttagactctcacatcaataaagcgagcgtctgaatcctttggctgaacagcttgaggctgctgctgaacttgatccagcatgaccatggcttgtgctgtattcgtagcaagctgtgaattcaacaaactaatattaagtgttttttgaatgctcgcgacttgctgactcatcattcctgcaatagaagacatcttctcccctcccttctcttttctcttcggctgaaagccctatgatttcaatgggctgtctgtcacgattccaacaaaaaaggaatgtcgatctcttaacgatcgacattccttccacatacgtattatcctaaaaatgctttaagcatccagttgtgtttctcgatagattgatgaatcgcaagtaacatatcacctgttgtttcatcgccaacttctccagccagctccattccttgttttaattcctcagcgatattggagaaatcatcatatagatttttcaccatttgctccgctgattcattaccttcagcttcttgaatgctagaaatttctaagcattctttcattgttgcaacaggctgtccatttaaagcaagcatacgctcagccaaatcatcaatgtatgtcgctgtttctgtataaagttcctcaaatttctcatggagtgtaaagaagtcttttccctttacgtaccagtgatagttatgtaattttacgtaaagcacagtccaatctgctacttgtttattgacgacgtgtaataatttttcagacatgtttattcctccttatgtaattgcgtttagtatgagaatacccttttcctattatactgaaacctgcgatgaatttcttctattttggctgcatgaaatatatgttaatatggaaataaggagggagttagatgctgctacttgggattatcagctttatcattatctcaatcgttgtctttttatcgctgtggacaacatcgaaggcttatgaatataagcataaaatcgatacaccacaggatgctgaaccaaaccaacgtcctaacccgaaataaaatgccacttaatgatgtgaagtttcttcttcagtagatgaactctcttttttcacatcacctacttgaatgttcgtctttggcatattatgctgctgtttagctgtcacatggacttgtatgatataaaggccatcttttttaaaggctgtatgcaattcatatacacctttattctctttctttggctgaatcatctggctgttatccttatcgccatctttccacacttcaaattgaacttcgtctgcatcatcgacaggcgtatcaccatatgtgacagctgcttttactataacgctttcatttttctccacttgttcaggtcctgtaagcttcacttctaatagctcaggtacctcccctttttcactatttgctgcagagttcccacatgcacttagtaacaagagcatcaatatcattcccaacatttttcgcatcccgagttcccccttcttttactgacatgtccattttaacaaatatcccctattttgacatctcatgatcgaatacaaaaaaaaccggacatcatcatgtccggtttatgattgattaaccaaatactttgagaagctcttcttgatcttgagaaagccagaaacgcatcaaacgttttgccccttcaaggtcatgaagcttcgcttgaccgcattgctcttcgtttgccgcaggaatttctgttacttcaactgcatccttgaatgttgcatcaagaagctcaacgatttcttttggagttggtgcaccactgaccactaaatagtagcctgtctgacagcccattggagatatatcaatgatatcaaaatgatcgtatttctctgagtgtgttctaatgttaaacgcaagtaaatgctctaatgtatgaatcgtatcaggtttcatcgcttgcttgtttggctgacaaaaacgaatatcaaatttattgacttctccatctgatcccactttatgaacgccacaatgacgaacgtatggcgcttttacagcattatgatcaagttcaaagctttctactgaaggcataatcaccactcctataattgcaatttcctatattataacatatttctccgaccagtttagtttataaaactttccttccttgtccttttttcttatactgtgaaagacagacaaggaggaacctttatgaaacaaatttttatcggcatcatacgcttttatcaaaaatgtatttcccctcttacaccgcctagctgccggttttacccaacatgctcaaactatgggctagaagcgatcaaaacgcatggcgctttaaaaggcggctggctcaccatcaaacggatattaaaatgtcatccgctccatcctggcggcatcgatcctgtcccgccgaaaaaggaaacataacttactttttttcatatccgttgacgactacgtcaagcttgccagttccaggatcaatgacaagaccgtgcacaggcacatttgatgggagaagcgggtgatttttcacaacggacacactgtccttcacgctctcttcaaccgaactaaagcttttgagccactgtttaaaatcgattcctgagtattccagtacttcaatccgtttttctgggataccacgctcaatggctttgtttaaaagtgtctggctgtctattttgctcataccgcaatcatgatgcccgatgacataaacctcgtcagcatttaattcgtaaacagccactaaaatgcttcgcataatacttccaaatggatgagaaacaagagcaccagcacttttaacgatcttgatatctccatttttcatgttcattgcacgtggaagcagctcgacaagccttgtatccatacatgacagaatgacagcttttttctgtggaaacttcgttgttgtaaattcttcgtatttcttttcttcaataaattgttgattatattcgatgatttcttctaaaagtttcatacgttgtccattcctttatctttttttaaaaataaatatagcacaatgtaagaaatttcgtcacgttttgcagcacatttttttaaaaggaaacatctgctgatgaaatttttttattttcctcttttcaaatcgtaattattacgatacaataactcaggacattaaatcgtaatcatttctatctaatagattgagaggagacattttccacatgaaaaaaatcttttatatgttaacagctgctttatttgcgatcggtcttgccgcttgctcaagcagtgcggggacaaatgcttcaaaaggaaaagcagacggaaagctgaccgtttacaccaccattttcccgattcaagatttcactgaaaaaattggcggttctcatgttcatgcgcaaagcgtgtaccctgccaatgcagatgcacacagctttgaaccaagttcaaaaacgatggttgaaatggctgaaggagacgccttcatctacagcggcacaggcgctgaagtattcgctgacaaaaccgcttctacgttaaaagaccaaggcgtgaaaacagtcaaagcagccgaaggcatcaaattgttatcgacaaaagaagagcattcacatgaagaaggcgaagatcacgatcatgaagaggaagatcatgaacatgatggacacgatcacggagataaagatcctcatgcatggttagaccctgtttatgcacagcaaatggcgaaaaacattaaagatacactcgtttcattagatccagatcataaagacgaatacacaaaaaactatgaaaaactaaaaaaagatttgcaatcgctagatcaagagttcaacacaacgttatctaaagcaaaacataaagaaatccttgtttcgcatgcagcctacggttattgggaaaagcgctacggcattgaacaaatcagtgtattagggttatccgcttctgaagagccttcacaaaagcagctcgaaagcattgtccaaaaagctgaaaagcatcacattcaatatgtgatttttgaaaacaacgtcagcagcaaagtctcagatacgatccgcagtgaaattggagcaaaaagccttacacttaaaaatttagaatctattactgaagatgatgcaaaaaatggtgaaagctacgtcagcttaatgaaacaaaatctaaagaccttaaaaaccgctttaaatgattaattgttaggcccgggtgatctcccgggttttttgctgtaaaaaagcacaccagtgtagggtgtgctttttttattacatttgatactttttcttaaacaactcggctcttccgcctttttctccgaatttttggcgtcctgtataaaaaggatgcgtatcagagcttgtttctactttaatgacaggatacgttttcccatcttcccattctactgtctcattggatgactttgtcgatttactcaaaaagcggtaaccgctgtttacgtccataaatacaacatcatgtgaggttggatgaatatctcttttcaatgtcaaaactcctttcgttatcaaaacgtaatgattacgctttatatttatattctactccctcttttacaacatgtcaaaaatcaagctttcttagtcaggaagaataatctaaaaatggtggagaataataacatcatgaaaaagagaagcgataagaaaggcggagaaaaaattgactgatctcgttttagctagaagcctgttcggcacaaccatgggctttcatattatttatgcctcgcttggcgtcggcatcccgctaatgattttgttagctgaactcatcttccaaaaaacgaaggaccctcactatgctgtcatggcgaaacggtggacgaaagcgcaggctgtcttgttaggtgtcgccattccaacaggcacgattgctggcacccagctcgctcttctatggccaggttttatggaggtcatcggaaaggtcatgtcactgccatttcagattgagatttatgcgttctttattgaagcattatttatgtctatttatgtgtacgcagcggaccgcctatcacctgctatgcgcatcattaccgttatttttgtcgtgattggcgcagccgcttcagcaattctgatcacaaacgtacatgcatttgaaggtacccctgctggctttcaaatggtcaatggagaaattacgaatatcgagccttggaaggcctttttcaatccaagctttgtcgtaactgcaacacatgtcgtgctgtctgcttttacaacaggtgcttttgtgattgcatcagtggcagcttttaaaatgcttaaaacaagaaagaatgagaagctctatacgtttcatcgaaaagctctttttcttggacttattgtaggaggcctcttctcatttcttacggccataaatggtcatgagtctgctcagcttctgtatgaatatcagcctgaaaagttagctggtgctgaaggtttatttgaaacacaatcacatgcacctctcgcaataggtggttttactgatgccgattcaaaggaaattaaaggagcaattgaaatcccttgggcgcttagctttttggcaggaaatagctttgatacggtggtcaaaggcttaaatgatttcccacgtgacgagtggccgcctttatttattcacacattatttaatggcatggtcattattggctcagtcctcattttgtttgcggtattagcactgctttaccgtaaaattttgaaacgcgaacattatccgaagtggctcctttttctttacttattcggcgggccccttagtcttttggctattgagtttggctggatctttgcatgtacaggccgtcagccatgggtcatttatcgaatgctcaaaacctcagaggtcgtcacatcatcaggctcaatcggtacgctctttatcctttttgccattgtctacctcatcttaggcatagcaactgtgattgtgctgacgtactactttaaaaaacattcgattgaagaagacctacggttaacagaatcttaaaaaggagcgatctagatgcaaatggatgtgacaactgatgcactcattgcaatcaccatcttatgggggttcgtttttatctatgcagtgatggcatcaatggatttcggcgcaggattttggtccatgatttatatgaataaagaacaaacaaaggccgctaatatcgcaaataagtatctttctccaacatgggaagtaactaacgtatttattgtggcaattgttgttgcgttgtttagcatgtttccaggagcgacctttgtccttggtactgttttattaatacccggcagcatcatattattacttcttgcactgcgaagcgggtttcttgtgttttctcattctctacctaaaaaataccgaaaagcagtgacttacatttcagggattagcggctttatcattccatcgatcctgatcatggttcttccgattactcatggtggatttatctttgaggagaacaacaattactcattagatcttggactggtctttacgagtgcaaatgtctattcttttgtcggctttgccattttcagcaccctttttctttcgtcattgcttttagctgatttttcgaatgtggctgatgaagatgaagcttacagtatttatagaagaggagcgctcattacgggtccgctttcactcatgatggcctttttcatcatgctgacattaagaagcgaggcaaattggctgttcacaaaaatgatgcagaacatccctattcttcttgtatcactcctgatgtttttgctagcagggctggctctatatttaccaaatagccggtttaagcatcgaaaaggccggccgcgtttagctgtcattgcgattaccattcaatattttttagcaagctacgtgtacggacgtgcccatttgccttatatggcctatccagatattacaatcatgtctggttttactgaccctgtgacatttagagcattatttatcacgtatattgtaggttttatcatcttatttccagggttctatttcttctggaaattgtttatgaaggataagcgctatattcgccaggaagattaacgtgaatggatgaggttcatttcggttacattatagaagaaagacatactcaaaaggaggtcatctgtatgagtcaaaaaatcctttgtgaagttaataactgttcctattggaatgctggaaaccgctgtggggcagatgcaatctatgtcgtcagccacacaggaaatacagctgaaaaaagtgaagaaacggattgtaaaacgtttaaaccacaagatctttaagtctcatttaaggaggcgcttcacattgaaatacgatcggctgcttcaaacgttttttgacgaaattcatgacgcggacgaagccgcattttatcaagcagctcactcctttttaaacctttgggattatgaatatggccctgcagcagacatgccaactgaaatgaatcactatattgaacagcttgcttatgacagcgaactggtagaagagtaagaaagagcgggtcaccgctctttctttttttgagacaggaaggaaaaactttctctcactatatatagattttatcggatgtgcaaaaggtgaatacctcattttcacatcacaaaatcatgttttgtaaacacgtcaattttatctgaaaaagaacgaagcgcttgataatccacttctactcccattcctggggaacgaggtacctcaataaacccattttcaaccttgatttcaggaaaaatgatatcctgctcccaatattttgacgaagctgaaatatcacctggaattgtaaattgcggaagtgaagcaagtgccacgttctgggcgcgggaaatgcctgtttcaatcattcctccgcaccataacggaatttgatgctccttactgaatgtatggattttaagggcttctgtcagccctccaactcgtgaaggcttcacattgataatttgacagctgccaagctctacagcttttctagcatcatctaaagaacaaatactttcatccaaacatatcggtgtttttaaatgcttttgcaaatggcgatggtcgacgatatcatctgcagctaatggctgttcaatcattaataaacgaatgtcatcgagctgcttgagcttgctaatatcctttaactcataagcagagtttgcatctgccattaatggaaggtgagggaaagactctctaatttttttaaggagaccaatatcctgtcccggcttaattttcaccttcacccgctgatagccttggtccacaaattgttgtatttgcttcagcatatcatcaacgggtcctaaccccgccacaacaccagaaggtattctatccttggtgccgcctaatacatctcgtaacgatttattctctcgcttcgcataaatatcccaaacagccgcttcaattcccgctttcgccatcttattccctttaaattgatacaggctgtctggtatttctgaagggtgtgtaaaggtgcgtgtcagcacatttggtataaagaaagctctcagcatatggtaacaagtttcaatggtttcttctgtataccaaggagaagaaaaagctgacacctctccccaaccagtcaatcccgtttgatcttttacctcgacaataataaactcacgctccgatatggtcccaagacttgtggtaaatggctgcttgagcttcatcgtgacatgatataaaatcactcgttcaatttgaatcatctaaaaaccccttttgactctgagtctgtgcctctgcaatttattcgacgcatttcttggcagctcgtccacaaagtgaaaagcggcaggccatttatattttgctagatgcgactcacataaagcatagagctcattctccggtattttatggtctgtgacaagaaaggcagccggtacctctccccatctatcatcatacatacccgtcactccggcttcctttacatgcggatgtgctaacaggaccgcttcaatttcagcaggataaatattctcaccgccagaaataattaaatctgaacggcggtcaagcacaaataaaaatccctcctcatccacatagccaatatcacccgttttcagccagccttgatcaaaggcagccgcggtcgcctcttcacggtaaaggtaccctttcatgacatttgcccctttcaccataatttcgccatgctcaaaaggacgacaaatgcgtgtaccatcttgaattttcagctcacacccaaaaaggggttttcccgctgatccaagtttctctacactaaattcaggcgcaagggtcacaatttgtgaacaggtctctgtcatgccatacgattgaaacacagggaagcctttctctttgctttcttgaagcatcgcaaaaggcgcaggccctccgcctaataaaagacagcgcaaagaagacggacattcttccagtctgcttaataaacgggataacatcgtttgaacaacagatatcatcgtcacacgatgctgttcaatagaaccttttacttcatcgacatcaaacttctgatggagtacgacagtcatcccataaatcacagacttaaataaagcggataatccgctaatatgaaaaagaggcagtgcaataagccagcggtcatcctctctgatgcccatattgagtacagaggaaacagcactatggaaatgattgccaaacgtttgctcaaccccttttgggcgtcctgttgtaccagatgtatacatgatcgtcgctgtttcatttaaatcaaattcgctttcgattttagttacattctcttgcccttcttcaggtaaagtctccattgtataaacgggtagttcacccttatgatcactggcataaacaggttcagtaaataaagcggctgcttttgcatcttcaagttgatagcgtctttcggcttttgttaacttattgttcaatagcacgattttgaatcctaatgacaaacaagcatgaacaagcatcaccatttgaggatggttgttcatcagaagaccgaccgtttcccctttttttaatgatgtttgtgcaagtctattggaaagctcattgacttcatcagctaaatcgcgaaatgtccactttttatcctgataaatgatcgcgactctttctggtgttaaataagcacggtgcagcagccaatttggttgcttcatcatgacacctcctttttgtaaaagaaaacagcttagtctgatgcactaagctgtttttcatcgatatcattgaatcaagggaaacgcgggaactgaccgaagtccggcttgcgtttttccttaaaggaatcgcgtccttcttttgcttcatctgttgtgtaataaagaagtgtcgcatctcctgcaaattgttgaattccagctaatccatccgtatctgcattaaatgcagccttcaagaatcgtaaagcagtcgggctcttttctagcatctcctcacaccacttcacggtttcctcttcaagctgctctaatggtacaactgtattgacaagtcccatatcaagcgcttcttgtgcattgtattgacggcataagtaccagatctctctcgctttcttatgacctacaatacgtgcaaggtagcctgaaccatacccagcatcaaagctacctacttttggaccagtttgtccaaagatcgcattatctgctgcaattgtcaggtcacacacaatatgaagaacgtgcccgccgccgattgcataaccagcaaccatcgcaacaacaggttttggaatcacacgaatcaaacgctgtaagtccagtacatttagacgcggaatttgatcgtctcctacataaccgccatgaccgcgtactttttgatctccaccagaacagaatgctttgccgccagcacctgcaagtacgatcacacctacattcgaattatcacgagcacgtgaaaatgcatcaattaattcactcacagtttttggtgtaaacgcgttatgtacatgtggacgattaatcgtgatctttgcgatcccattgtacgtttcatataaaatttcgtcatattgacgctcagtttgccattcaatagccatcaatagttcctcctctaatcttgcgtaataaagtcacttactattttaccaaaaaaatgtggttgttccacatgaactgtatgcccagcctgctcagccaatataaattgactgccttcaagctcctgctgcatacgtgcagcgatattgcagaacttttcatcaagcgctccgcaaatcaacaaaacaggtaattttatatgctttaatgccttccaaacagagggctgcgaacctgttcctatgccttctaagctgcgagccagtccaagtggattggctttcagccttccctctcttagttgagcctgcgtgtcagctgataaagttctttgcgaagcaaacagtggaatactctcccaaaaatccacaaacttcactaaaccttcatgtctcattttctgagcaagctgatgatcatgcttgagtcttgccatccgctctttaaacgtgcgaagccctggagaggtactctctagaatcaatttgtttactcgctctgaataacgagtggcaaatgataaagcaatacgtcctcccatagaatatccgagaatattcactttgtgaagctttaattgatttaaaatctctgcaagatctgccagttgatgcgacatcgcatatcttcttatactttctggtgagtccgtgcggccatgtccaagcaaactgacttgaatcaatctcgtattctccatataagcattcaagaacgtccaagaagccgcgcttccagtgaagccatgtaggcataacgtggcattctcacctgatggattttgatccaccacctcgtacgccacaccatcacgcatccgtattatgaaagaagacattcttttttcacttctttcaatatgtcatccatcatttgacgatgcttgcttgcacgagaatgccgatctgtttcaatttcaattaaatgaagtccaggctcttctatatgcgccttgtagacatcatggaattcttgtttcgttgacggtttcgcataggttcccccatacagcttcgaagcatactcaaaattcagtccagtcggtgtaccaaagagtttttcataatacggttcctcagacgcctgcggaaggaaagaaaagatgcctcctccatcattgtttaaaagcacaaccgtcagtggaatgtccatcaacttcgctgcaaggagaccattcatatcatggtaaaatgataaatctccaatcactaaggtgaccggctgtttcaaagctgcatacgtgccaagtgctgtagacacaacgccatcaataccatttgctcctcgattcgccatcattcgaaaaggcttcaattgcgcttcaaaaaatgtatccacatcacgaatcggcatactatttccgataaaaaggacactctccttcggcaatagatgctgaagctgacggtacacattcccctcaaatgacagatcctcatcagaataatgggcagcatgcgttctgaatgatgaattagcatcctgccagcgctttagaaaacttgtatcctcacgttgatccgctctattgactacttcatctacaaaagctgccacatcactttcaatgacgtatgaagcactcagcccaggatctcgaaaacctccagcagcatcaacaacaatctgattgacttccacatgtttttccaaccacttgaataaaggcttagacacaggcatcggtccaaaacgaatgaccatatccggcaataggtgctgctgcaatgcttcatctttcaataaagaatcatacgcatcaataataagacctgcatgctcatgaccatttcgtaaatgagaaagcgggtccgctaaaatcggcatatgcaaggcttttgaaagacataacactgcctctttttctttctgagtatgaagctcaccacacacaatcagtccctttttggaacggttcatgcccgtcacaatttcagatatcgcatcacaatttgggtaagcctgtcctgtagctaatacttttttccggtctgtttcttctctctcgaaaggatcaatagacaaatcaggaagcaatggttctctcagagggacattgatttgtacaggtcctttcggctcttgcatcgacatatgatttgctcttgccgcagccgtctgaacatagcgcaacatcgtctgactgtcttctggcactgctaagtctgtgaaccatttaacaaacttaccgaataagaattgctgatcaatcgcttgaggtgccccaacttccctcaattcgtgcggccgatcagcagttaaaacaataagtgggacacgggaataatgtgcctctacaatggctgggtaaaagttagctgctgctgtacctgatgtacaaataagcagcactgatttttgacttgcttttgcaagaccaagcgcataaaaagcagcagaccgttcatccactaatacatggacattgatgtcttggtgggctagagccagcattgcaagcggggtcgaacgagaacctggacagacaacggcctcttgtacgccgccttggacaaattcatccatcaatctgccaatatatgttgtcatgatttgattattcaataggacgacctccaagggcagatagcattggtcttaattttacttgcgtttcctcgtactcctgctttgcaagggaatcctctacaatgccgcagccagcgaacaaacgaacatggtcttcctcaataagacctgaccgaatggcaacagcaaattctccattatcctgagagtcaatccaccctaccggcgctgcgtaccagccacgtttcaacggttcgatttcacgaatgacctcaactgcctttttcttcggatatccacctaatgctggcgtcggatggagctgttcaattaatgaaaagagagaacagctgcttttaatttctcccacaatcggtgtaaacaaatgctgaatgttttttgttttataaagactaggttgatttggtttatgcacgcgaaggcaattggcctcaaatgcttgctcaatcatattgacgacaatttgatgttcaatcaaattcttctcatcatgcagtagctcctcgcctaatgctcgatcttccgcttcattttttccacgaacaatcgaacctgctaaacaagatgaaaagacctctccgccgctttttttcactaagcgttccggcgtagctccgacaaatgcttgtctcccttgttcaaccgcaaatacataactcgttgtttgatgctttaataattctgataacagtggagcgagttcaatttgatttttatagtgaagcaagacttctcttgctaaaacaaccttttcatattcgtttgcacgaatgtggtctgtcgcttcttggatcgccttcatccattccgtcacatctcgttcttccatatgaacaagttcggcttgtccatcatgtctgagcggtaatgtttcgaaatgagaggctttttgttctaattcttgaatgagctgatgaacattcccgtccacctgcttccattcattgatcgtaagaaacgtcccttctttcgagacagtgagcatcatcgatggcacaaaaaaatgagcctcgccaaaagcttcccagtgacgcgccttctcttcaaacggatcaaatgagaatcctccaaataaaagcggaccaacagccgcttgccttaactccttctcatcatgaaaatggaacatgtgctgcttcagctgttcccattcttgatggactgtatcaaatcgttccttgccttgttcagatgatttaataacggccgctctgccaagtccagaaaatatcatttggctttctggatcagaccaaaaaaaacgctcgcctaaaaaatccgcttcgccgctttggaaaaaggcaagaggatccagatcgtcaactcttctggagtagcttatcaaaacagcatggttgacgttattcgcttcttctaatgtcgcaagcgcttcctgccggaaagtactttgcactgttgtcaccatgatacattcctccaaaatccatgaaataacataaaaaaataaaaccataatgaaaaaatacatgaacattcgagtatgtcgaatgacctgcttttctattataaaccttaacagatgaacttagtaaagaaaacagcttttaaaacctcgaatccttattatatcacgctttctagattttttcgctcctgcttcttgaaacgagagcatctataagaaaattggaaagtcttgttctaagatcaagctttctctcgatatggcaacgattagcaaacatctttttcaggtttcatcgcatcaatatattgacacccttttgaactttgctaaactggaatttggacgtgtacgtatttttttatttaaaggagtatattttatgcagcatcaatcgatatcagatcagctttcaccgattaagcctgataagaactggcggatttggtggaatttactacgaccgcatacattaacagcagcatttatccccgttactttaggaactgttctcgcacttccaagtggtcaaatacatgttgggctatttttagctatgctgtttgcatctatgtttatccaaatcgcaacaaacatgtttaatgagtactttgattatgttcgcggattggacaacgagaaatctgtcggcatcggcggcgccattgtcagaaatggcgtgaagcctaaaaccgttctcgcccttgcttatgcactatttgcgctttctttactactaggggtatatatttgcatgatgtctagctggtggattgcactgatagggctcatttgtatggcagcaggctatttctatactggcggccctgttcctattgcatatacaccgtttggagaacttgtatcaggtgcgtttatgggattaggaatcatcctgatcagtttctatattcaaacaggcacactgacgtctaaagcggttctcgtctcattaccaatttctattttagttggtgccatcttactatcgaacaatatccgcgatttagacggcgataaagaaaatggacgaaaaacacttgctatccttgctgggcgaaaagctgcagtaaacattttactttccatgtttttgctctcttatgtacttatttttgtttatatcttcacagatattgtcgacctttggagccttcttgttttactcagtgtcccaaaagcatatacagctatcaaagaatttaagcaaaaagaaaaaccaattgaattaatgaatgccatgaaatctacagcacaaaccaatacatttttcggtttcctgctaacaatcgctttgattttacagtactatattgcttaacaaagaacgcctggcccagccgcaggcgttttttcatgaggaattgcttcaaattggaactagtcttacagataaaattgctcatactaacattatgtttgatatgaaaggatgatcgctttgttgtctaaagacgaattacatcatttgaagcagcgacttctcgatgaaaaacacgaactcgaagccaaaagccatgacgatgaacaaaaagtatcatttccttatgattctgtcggagatctgtcagcctatgataatcatccaggtgatcaaggaacagagctgttcgaacgcgggaaagatattgcgttaaatagtttagaacatgaacatctgttagacattaatgaagcacttcaagccatcacagacggctcttatggactttgcaaggtttgtaaagcccctatcccaaaggaacgtttagaagccttgcctagtgccgtcacatgcacagagcattcaaaagaacaaaccgtttcacaaaaccgtccaattgaagaggatttattaagtccgccatcagggcaattcgaaaatgaagaaagtgcagcctacgatggagaggatgcatatcaagacgtagaacgctacggaaactctgatacgccatccgatatggaatttcctccattgacatacgatgatgtgtacactcaatcagaagatgaagattatgtcgaagactatgaaggatttgcagctgctgatattgagggcaaggcaagtaaggtgtatccaaataaagcccacgaagcctatgaagaagcattagacgaagagggcgtcatgaccgtatttggtgatttgaagccgtacgaagaggaaccttatacagaagaaaatcattagtcccctcataatgggggcttaatgtttatatcatgtaatgattgggaaatcactttaagagtgaatttgattggaggagatttttaatggcgagaaaaagtatcatttgggcagtggttgtcttttttattacatacgcattattctctattgccggattcttgtttccgattgacagagagtggtatgatgcattaaataaacctgaatggacaccaagtggtggtgtaattggtgctgtatgggctatcttatttgctctcatctcgttgtccgcagcgatcatttatggaaagtacggatttcaaaaaatcaccttaccattttggattctttttcttttaaattatgtatttaatcaagcctttagttttttccaatttacacaaaaagatttatttgctgctacaatcgattgccttcttgtagcactgacagcacttgctcttgtcatcgtctcgcgtaaactaagcaaagtcgttccgattttactaattccttatgtcttatggggcttctttgcaacttacttgtcttatacgatctattccatgaacatgtaaaaaaggaccgctataatggcggtctttctttttttgaagaaaataaaaaaagagatctttgacaagatctcttttaaatatgacccgtacgggattcgaacccgtgttaccgccgtgaaagggcggtgtcttaaccgcttgaccaacgggccagataaatggcggagaaggagggatttgaaccctcgcgccgcttgcgcgacctacacccttagcaggggcgcctcttcagccacttgagtacttctccatttggctccgcaggtaggactcgaacctacgaccgatcggttaacagccgatagctctaccactgagctactgcggaatatcatggtgggcctgagtggactcgaaccaccgacctcacgcttatcaggcgtgcgctctaaccagctgagctacaggcccatgaatggatatacaaatggagcgggtgatgggaatcgaacccacgacatcagcttggaaggctgaggttttaccactaaactacacccgcaaaaatatgtatggggcgattgatgggaatcgaacccacgagtgccagagccacaatctggtgcgttaaccacttcgccacaaccgccatactatcaatatttttttataaaagtgatgaatgatgatcggccggccgtgcggacaggtgaaagggtcattggtttgccgcaattcatctaataaagctttgatttcatcatttcgcaaatgacgatttgctttgatagagcctttgcagctcatcatgatcgccgcttcttctcttaattttttgatatctacacgcttctcatccagcacttgctcaataatttcttcgatcagttcagcctcttccccttttggaaaccactgtggatgcgaccgaacaatgtagcttcctgaaccgaaaggctctaagaagacacccactttcgttagtatctctttatgctcatcaataatcagcatgtcgtttttcgagtagtggaatgttaatgggacgagcatttcttgcacttcctgttcgatctctcctaccttctcacgataatactcatacttgattcgctcctgagccgcgtgctgatcaataatataaagccctcgttcattttgagccaaaatatatgtgccgtgcatttgcccgatgggatacatgacaggaactcgttcgttttctgaaatggtttctgcagcatcctctctcagtactgattcttcatattcaagagaagcagcggattcctctacatggatacgctcagacggagtatcttcattaaatacgggtgatgatgctcctgtcatttcctgcgtaggcgtcccgtatgtgtccatctgatttgtctcgtatacaaccgattcgagagactccgactgatagggtagcgatgttctcgcctcgtttgtatttgcttttttcgcatcaaaggttaaggattgctgctcatttttgatcgctggcattggtgctttctttggcaccgaagcacttggaatgagctgctgtttttgaaatacgtccttaattccttgtttgattagctcatgaagttcctgctctttactaagtctcacttcaagcttcgaaggatgcacgttcacatccactaaaatggggtccatcttcatttcaataaatgtaatcggatggcggccaatcggcagcaacgtgtgatacccttcatggaccgcttttacgagcggaaaatgcttaacatatctgccatttactacagaagacatataattccgtgatgcccttgtcacttctggtaaggagatatatcctttcacttcaaaatcaagtgattgcacgtgaagtggcaccatttttttcgcaacagctgtcccataaatggccgcaagcacatgccgcacatccccgtttccattcgtctgaagcaggacctttccttggtgacgcaagcgaatcgatacttctgggtgagccagtgcaattcgattgacgacatctgatatattgccaagctccgtatgaacggttttcatgtattttagtctggcaggcgtattgtaaaataagttggtaacgacaatttcggtaccacggcggccagaggtttttttctctgaaatgatctttccgccttgcagcacaaggtgcgttccagctccttcaccagtacttgttttcatttccagatgagagacagatgcgatacttggcagcgcctctcccctgaatccaagcgttctgacacggaacaggtcattttcatctttgattttactcgttgcatggcgctgaaaggcgagcttacaatcttcagcatcgattccaacaccattatcaatcattctaatagaggaaagacctgcttcttctacatcgatttcaatcactgtactgcttgcatcgattgcattttccataagctcttttacgacagaagccgggcgctcgactacttcacctgcagcaattttattggataggtcatcggataactgaataatctttgccattttgctcacctcatcttacattataatttcttttgcaattcatatagtttagtcatcgcttcgagcggagtcatatccattagattgaatgactttaattcctcgatcaccgcttgatctttctgttttagaactggtttggtttgcggtttttcttctacttcaaagaaagaaagctgctgtttttcctcagccttttctgtttttggagctgctgatacgtgcggggtcacctcatgtgatccgctctcaagctccgtcaaaatggtctgggctctatcgatgatcgcatcaggcaattcagcaagctgcgctacatgaataccatagcttttatcagctgcaccctctttgatttgatgtaagaaaacgaccgtgccttcatgctcttcagcacgtacatgaacatttttcagctcgcttaattgagattcaagaactgtcagttcgtgataatgtgtggaaaaaagcgttttggcaccaatatgatcgtgaacaaattcaatgatcgcctgcgcaagagccattccatcataggtgcttgtcccgcgtccaatttcatcaaataaaatcaagctgtttttcgttgcatgcaccatcgcattttttgcttcgagcatctctaccataaaagtactctgaccagaaatcaaatcatctgctgccccaatacgtgtaaagatttggtcaaagatcggaagggttgccttcgatgccggtacaaagcatccaatttgcgcaagaatggagataagcgccatttgcctcatgtacgtacttttccctgacatattcggtccagtaatgagcaaggtttgccggccatttcccatatggcagtcattcggcacatactcctggtgatccatcactttttcaacgactggatgacggccatctatgacatctacctcatcctctgagaattctggacgaatataacggcgtttttcactgacagtcgcaaagcattggagggcgtccagctcactcatttgttttgcgagcagctgtaatctcggaatatagactttcacttgttctctgagagctgcgaatagttcatattccagttcgctaatatttgattcggcctcaagaatcagcgcttctttttctttcaattcaggtgtaatataccgctctgcattggcgagcgtttgttttctttcataacgcccttcctccagcaaatgcgtattcgctcgtgtcacttcaatataataaccaaatactttattaaacccgacttttaaagagcgaatgcctgtatattctctttcttgctgctcaagccgtgcaatccagtccttcccatttcggctggcatcacggtattcatctaattttgcattgtagccgtctttaatcaaattgccttcttttaacgtcattggcggattttcatatagcgcatcttctaataaattcagtaaatcatcacaaagatcaatatcattcgctcttgatttcgccatttcctctggcagtgagtgcacaagttctttaatggctggcacttgctttaaggattcctttaactgaatgagatcacgggcattgacgttgccaaacgcgacgcggcccgctagacgttcaagatcatatacttgcttcaaccgttcacgcagatcctctcgttcaaagagatggtccatgagaatttgcaccatttcctgacgttctttaatgtgcgaaagacgaattaacggcctgtcgatccattgcttgagcagccttccgcccatcgctgtttttgtttcatctaacagccataacaaagagcccttcttgctttttgagcggatcgtctctgttaattcaagatttcgttttgagtaaagatcaattttcattgtttgttcgagctcaaacacttgcacttgctgaaggtgatcaagacttcttttttgcgttcttcttaaataagcatataatgtcaaaaatgccgatcttagttgctcgctcaggcgggacacgagtcgctcagcttcatcgattaattcatcactatcttcgtatgaaatggtcgcttggcaccgttcctttaaggtcttgactgtttcctcatccagctgctttgacaccacaatttcttttgcaccgacagaataaatttcagacacgacttcatctaatcgatcgatgaaagccgccatgttttcaccagtcgataaatcggaaagtgcaagtccatatccattttcaaactttgtcacagaggcaatgaagttgttttcattttcacttaagcctttaccatccattaccgtacctggtgtaatgagttgaacgacttctcttttgactacaccttttgccgttttaggatcttccacctgctcacaaatcgcgaccttatagccttttgaaatcaattgttctatgtatgcagaagcagaatgataaggaacaccacacattggtatagttccgccatctctacttgttaacgtaatctctaattcttgtgacgcttcttttgcgtcatcaaaaaacatttcataaaaatcgcctaagcgaaaaaataaaaaggcatcttgatactctgccttgatttttaaatattgctgtatcatgggcgtataacttgccatatttctaatccctcactatattacattcgaattcataccatctttcattatagcataaaaaaaccccttttttctcctagataggacacaaaaaaactagggggatatgcgccctagtcatgaattactcttctggatcacccgctaggaattctggatgaatatcctctaactcctcatccacctcttcttcccactcatgatcatctttttctttccagcttgaattgacctctacaacaatttttgtttcccctaccacttcagcaatgaattcccgctctgcttgaacgataattttattgccgtttggagaaatggtcacttctaagcaattcggctgctggagcacttttgcaatcacttcatgctcatcatcaaggaaatttttatctttatatctcagtttgatgatgtctacatatttcacccgttctgtgacgacttctgttttcgtgttatcggcgtaagaataccatacgttaatatcaaaggttccttcaatctcaacagttttaccgaccttttcagcatcatacttatgattaatgatccaaccacctaggatgctggttggtttttgcgatggagaaatggtgtgtgtgctttgggtgaatttcctcccttttgcaaccaccgcttttgtaataatctctctgtattcagacattccggcatgcctccttgttcttgatcgttttatcttatgctgggcattcgtctagtgtgtcacgattttgaacttcatgttcaattaaattcatttctgtttcagtgtatgcatggtcgcccataaacttgccttgaaaattggaaaagttggagagtgagagattttggggtgtcgaagcaagaagtagaacgggaagtgtgatttttgttctttcaaaaatgatgatagcaaaacaaaaacccccgcagatgcgggggtttctcatttaatggagcaacttggtgatgagtttttcacttttgaaccggtttctcctaacaagaggtcgcctccggttgaaagaatgatttcatctgttacttgattagaaatcgtatgcgctacgagctgtagcagggaattgacttccacttgtgattctttgaattcttgaatcaccgggatttcatccagttcttcttgcagggcatcgattttttcttcgacttgctttaaagcttcatgtttgccgtaatgctttaaatttacagcttgtttttgaagcgccttaatttggttaataatcgttgaaatttttgtattttcattgatttgcgcttctgctttcttgaagaaatcaacttcttctgtttcagaaatcattttagcgagctctcttgcgcgctcgacaatctctttttttgaataaagtgtcattttaattcacctcgatagcttctccaaccatttctccgtcaagagaccaagttttggcttgtgtgattttcactttgacgatgttgccaatcgcttcttttggtgctttaaaattcacaagcttgcttttacttgtatatccggctaggatttcagggttgtttttactttcaccctctactaatacttcgacagtctgcccttcgtattccttcatttttttcgcagaaatttcattcacgagtgcattcaggcgctgaaggcgttctttttttacgtgcatcggcacgttgtctttcattttcgctgctggtgttccttctcttggagagtaaatgaacgtatatgccgcatcaaactcaacctcgcgatagagggaaagtgtttcctcaaactgctcatctgtctcatttgggaacccaacaataatatccgttgttaatgaagcatttggcatcgcttttttgattttgcgcacaagatcaaggtaacgctcacggtcatattttctcgccataagtttcaagacagaagaactgccggattgaactggcaaatgaatatgatcgagaaggttcccacccttagcaagcacttcaattaagtgatcgtcgaagtcacgtggatggcttgttgtaaaacggatacgcggaatatcgattttacgcagctcatccatcaagtgtccaagaccatattccatgtcttcaaaatcttttccatacgcattcacgttttgaccaagaagggtaatttccttatatccttctgccgctaaacgtctgacctcttgaataatttcatcagggcggcggcttctttctttaccgcgtgtgtaagggacgatacagtatgtacagaatttatcacaaccgtacataatattcacccagcccttaatttttccttggcgggctctcggaaggttttcaatgacatcgccttcttttgaccaaacctcaatgaccatttcttttgaaagatagcattcagataacagctctggcaggcggtgaatgttgtgtgtaccgaaaatcaaatcaacaaatggatgtttcttcaaaatacggttgacgacagattcctcttgcgacatacatccgcagacacctaaaattaaatctggcttttcacgctttaatgcttttaaatgaccaagctctccgaacactttgttttccgcattctcacgaattgcacaagtgtttaataagataacatttgcatcttccgttgagtttgtcggttcataaccaagcgccataaaaataccagccatcacttctgtgtcatgctcattcatttgacagccatatgtgcgaatataaaacttgcgcccgtttcctaacccttgaaaacgctcgtcaatttgaaattgattgtattcgacttcttctttaccccgtttttttgcatcttttaaggaaggcggaatgtacacagcttcaaaatactggctgtagtccttctcggattttttgtccgatgaacttacttgtccgctcgcttttctctgctcttcattcatgaatttgtactcctttcaaaccaagctccaccctacagtatagactattttgtcgtgaattgaaaataaattcatacgtgccatcacttttcaatccacacgaattttgcatgaatattgagtaggtttcagatgtagatcgtctttacctaaagggttttgtatttctttgacaatcttcatctgctgtgtaccgacactctcaactaaagtaattacatatgattctttttcctcttctgctaccattctttcttgttcagataagaagaatggaaagtcatggtgagtcagtttagatccttttacttctataagcttctcttttccatcggggtaataagatttaatatcaaatccatgaccatcttccgtttcagctacccaatcgacagcttccgctaattgttcccgtcccactgcttttaattgctctacttccttatgataaacaaatttctctgctattctacctgtctcttcgttttgctttgctctttcttctcttaattgtttataaacatctctatgaatgattctttttcttttatacttgttctgatcttccaattttggggtaaggtcctgatccaaatatatttcgtaaacaaaatcataaaaaaactcatttaaagaattgatatcttgtattaattggtaatagtcaaaatgatcaatattatactttttaaagaccaatgagcttgctgcatattttttaggtcttaatgatttacccaaatgaaaatcacctatatgaaagccctctagtcttttatgttgctttaattccggctgtagcctttgcctccaaatggctgcctcttccttaatttcagataaagataaattttcagttccagtttcaattgttaaataaaaatcttccccgttctcagcgaataaaataacaataaatatacctttttgtgtcgttgttttttgggaattaggacttgtcgttaatctcttgtctaaaagtgcaatccaaaaacattctgcaacttttccatttcctgtagatgctttaatatcgatcctgtccaaattcctcatatgacgtttttctaattcataacgaatgttgtttgggatctctttattaaacatgttgtgaaaagggtgattcttatctgttctccctttgttcttataatctaaaaattgctcacaaaaaatttttttattaaataacatttgcctcaccacttacctcaatagatctttttacatacattatacataacaaacggtagatttgatgaaatatggaaagaatagtgcaaaaaaaagagagcctgcgctctctcaatcaagtacgttcagtttttttgcttcttcttcgatgatcgtcagtgcacggtctagttcttcttttgtgtgctctgctgtgatgatggctctaattctcgcttttccttttgctacagttgggaaagcgatgccctgggcaaacacgcctcggtctattaaagccttggaaaagcgaaacgtaagagcttcgtctccaatcatgattggaataatcggtgtttctgtcggagcaacttgaaacccaaggctgacgactttttctttgaaataggcggcgttttcccagagcgtgctaatgcgctctggttcatctagcagcacttcaatcgcttcttcacacgctctagtcacagctggcggatgtgaggtgctgaataaaaacggtcttgctttatgctttaaataatcaattaaaacggctgatcccgctacatagccgccgagcactccgacagccttactaagcgtcccaacctgaatgtgcactctgccgtcgagtttaaaatggttgactgtcccgcggccattttcaccaagcacacccgaggcatgtgcatcgtctaccatcacaaatgcatcatatgcttctgcgagcctgacaatctcaggaagcggtgcaatatctccatccattgagaacacaccgtctgtgacgatgagacgaacgcggtaattcatagatttctttaaaattttctcaagctcttccatattggaatgcccgtatacctttttatctgcttttgttaaccggatgccgtcaatgattgaggcatgattcagttcatctgaaatcacaatatcatcttttgtcagaatactagataaaaccccttgattggtcgtaaagcctgattggaacacaagggcggcctctgtctttttaaatgcagcaagctttttttcaaggcgttcatgcatcgtcattgtgccagcgatcgttcgtacagatcctgtaccagcaccgaattcatcaatggcctcttttgccgctttcatcagccttggatgtgaggtgaggcctaagtagttatttgaggagagctgtatgacggattgttcatttaatgtcacagtggatgattgttttgagtcaatctctttcaatgtttggtgagtgccttgctgcttcattgtttccagttcatcttgtaaatacgtgaattctttcatcatttcttccccctttgatttgatggcatcatcagtacgacctttccgcacatcccatttctcatgagttcaaatcccttttcgaactgttcaaatggcagtgtatgagtgacaactgggtggacatcgatggtcttcgttcttaataactcagatacttgacgccacgtctcaaacatttttcttcccgtgatcccttgcacggttaatcccctaaaaacaatttgattcgtaatgtcaattgtcactggtcgttctggcaagcttagtatattgagtttccctccatttgcacaagcttcgagtgcttgattaatggcaactggatgtcctgacatctcgcatatcacatctgccccctccatctgcgtgaactgcttaatcacctcaacaggatcatcttttccaatatccacgatatggtctgcccccatttttcgggcaagatccagcctgtattcattttgatcgacagcaaacacttgaacagcaccggaagctttcgcgacggcgatcgccattaaaccgattggtccgcagccaaaaatcgccactgacttacctgaaacaggtgtgtgcagcactgtatgaaccgcatttccaagcggctcttgaatagacgcaagctccactggcatttgagctggattgtgccacacattttgttcaggtactttgacatattcagcaaaacagccgtcaatgtctacccctaaaattttcgtttcactacacaaatgctgctgcccagttaaacacatagagcactgattacatacaacatgtgtctctgccgatacaaaatcccctacttttgctcgagagacttgcctccccgccttgacaacttcccctgtaaattcatgtccaaaaatgtagggcgctttaactcttccctttgcccaatcatcccagttataaatatgcacgtctgttccgcatattgaagtggctttcacctgtatcaatacttcatgatcattgatttctggaatcggcatctccatcaacaccgctccgtaagcgctttcttttttaacaatcgctttcatcgttccacacatgacgtacaacccctttgttaaaaaacttctcccaatgagattttaacacgtcttattttcttcgtaaataccactgtctactggaaaaggacaaatgagcactccacatatttttttggatatttttctaaaaaaaaaagcaaatccccatagaaaaggagatttactttttgattcaccgtctttttgaaacggcaatatataaggctggcacgattaatagtgtcaaaattgttgagaaaaagacacccgatacaatgcagattgccaatggcttaaagagcggatcattacttaatgctacaggcataagggcgacaagtgccgtaaatgcggttagtaaaattggcctgatccttgctcttcctgcttcaatgacagctgtctgttgatcgaatccttgtttacgccgctgctcaataaattcgaacaagacaaccgcatttcggaccacgataccagctaatgagacaattcccattgttgccataaagctgaacggcgtttgtgtgacaaatagtccgataacagctccagatatcgctaagtaaaccgttcctagaactaatagtggcagcatcaatgaattgaactggaaagcgatggttacataaatgagcagcaagacaactccaaacaagagactaatttcaataaagaactgggattgattttcattttctccgccttgagaaatagctagatccttcgctgcatccgtttttcctatttgatcgacgacttctttcatgtcgcctttaaacgagtctgacgtgccagggtacgccttcagcgtaatggtcgggattccattttcatgtggaatgctttcatactgctctgtttctttttcttttacatatcggctaagtggctctagtgaaggcataccgccttcatttgaattgacaggcacttttattttgtttagctttaatccattttgatgtgtacctacatcctgtttgaccactaagtcgatatcttttgttccttgtttaaagctgcctaatggcatgccttctgtcacaagaccgagctgtctgctgacaaactgagcgctgaggccatcctctgccattcggtcacggtttagttcaaaggagatcgtttttactggctgattgacatcgtcagtaatcaagcttgctcctttttctttcatttcacttgtgagcgtttctttgacatcaatgagctttgcaaatgagtcacccgcaatagttactgtcacaggcgcaccagttgggggtccttgaacaatggttttcataaagatatcagcatctttaaatttcttacgcaacggctctgtcatacgatcgatcaattgtttactcgtcatctgatcattgtctactctcacgacaacctgaccagtatgatcacttgcatttgagatactttcattaaacagattcggtacaccgccgcctgcaaagatcgccgtctcttcaatacctttctgctgttttatctcttgttctattttctctaatgtttcatttgttttgtctaatgttgtttcactcggaagtgtgacagtgacaaccacttctttcttattcgctgcagggaaaaattcaaatggtgtgatgaaaattagtaaaaaggcaagcgttgcaacaagcaaaccacttaagccaataagcagcggacgcttcacaatgttcgtcagcacgcggtctgcataaaaatcagctaatttttttaacggtttgcctaggaatcctggctctttttgaattttcttgttctgtctttttcggttcacggtatattgatagactggcactagagtcagagaaatcaccatagacgcaagtacagtcgtcacgaggacagacggtaatgctcgtataaatgaaccgtttgcacctgataggaaaacaagcggcaagaaagcaaacacaactgcaagtgtggaagtcaaaatagatcctgcaacttctttgacccctgcaatcgttcctttcagcggactttcatattttttcatctgccttaaaatattatcgttgacgacaatggcatcatcgacaagtattcctagggcaatgataaagccgataatcgaaatctgattgaggtccacttgtaaaaatggcagtggaatcgttccgattgtgattgataacgggatggcaagtgaaacgataaacgcaccgccaatggtaagaccaagtgtggtgacaacaataacagcgatgaccgcaacaatggcttcttttatcaaatcattaaaaatggcatccacttcacttttttgtgaatagtagtttacccactcgacgccatttggaagctctttctctttctcaataacatcactgactttgtcatacattttagggatatcaagccctggtttgatattgactgtaaatgaataggcaggctttccgttatacgacacaatgtcacttttctctttttctacttcttttaagctgccaagctgactgattgtgaccggctcccggtttgttttggagaagagctcaagctttttcacttgttccaaacggtcgtaggtacctatggacagcttaaccttctcaccgcctgtccgaatgtcacctagtggggatgtgtcaaactcctgattgatggcatttgtgacatccgttacatttaacccttcatcctctagtttgcttgaatctaaatttaataccgcttgcttgtcattgaatcctttgatgacgacactgtctacccctttgatgtcctcaaccttttccttcaacgcacgcagcgattcctgactttttgctaagtctgctgattgacttgccacaaccatataagaaccaaccggcacgttgccaaactcatcctttacatcaggctccatcactccatcaggaaaggacgacgcagtacttgtggtttcgttcttaatttgacttgccaccttttgaaagtcggcttgatcatcaatttcaagcacaatatttgaaaaaccaatggcagaaacagagctcgttttctctactccattgatatcagatatggctgattcgagcttattggttacatcactttctacctgttttgcatccgcacccgggaaaacggtggaaattgtgacgatattcgcttgaaattctggcagttctcgcttaggaagctgcgtaaataaatagccaccagcaatgagaacaataaaaaataaaataaaaacaagctttcctcttttcaaaaaagcttcaaccattatttcacctacttaaatatttgtttttgatgaagtacttttaacttaatcttaatttatcatcatggtgaaaaaatgcaagctctaatatgtaatttttatctatttcatgaactgaatatgttatataagaaatgtatagtggtaaacaaaaacaacctgcttacatgatgtaagcaggttgaaaataataaaattagaattatcgtggctcaacaatcaatttgatggctgttctttcttctccatcgataagaatgtcagtaaaggctggaatgcatatcaaatccactccgcttggtgcaacaaatccccttgctatggctacagccttgaccgcctgattcagcgctccagcgccgattgcttgtatttccgctgcaccgcgttcacgtaaaacgcctgctaatgctcctgctactgaattcggatttgactttgctgaaacttttaaaatttccatttctgctcccccttaaatttacaatggataagtgagtgttcattagaacaatctttgttagatgatgctattttttgaaaatccatccccaaaatgtttttcaaaaatagcaggctacctaccatttttactatattcacgatagagggcgcatattccttctttctgattaatatttttctgaaataaatttgtgaatatttattcaaagaaaatatggtcatcatttatcaaaattcgatcaattttgacagcttttttcgactgttcgtcaatttctacgatgactgcacttaatgtcgtgcgtccttctgcaatctcaaaacggacgggaagacttgtcttaaatcgtttaataatcgtctcccgatcaacacctaaaatgccatcataaggtcctgtcattcctacatctgaaatataagcagttccttttggcaaaacgcggttatcagctgtttgcacatgtgtatgcgttccaacgacacatgatgcacggccgtctgtataccagcccatcgctagtttttcacttgtggcttcaccatgaaaatcaataaaaatgaacggtgtacgtttggatgcttctgcaattaactcgtctgctttttgaaatgggcagtcaagtgggggtaaaaacgtacgtccttgcaggttgatgacggctaattcttttccttgtttttttataaacgtcaaacctttaccaggtgtgccttctgggaagttcgctggacgaaccatatgggcagcgtcatcgatgaaatcaaaaatgtctcttttatcccatgtatggttgcccattgtgagtacgtcagctcccgcttgcagcagctcatgatagattttttctgttattccttttccatgagcagcattttctccattgacaatggtaaagtggggctgatattttttctttagttttggtaagtattctttcagtgtgtctcgtccaggtgaaccgacaatatctccaacaaataatattttcatgcgctttgaacccttcctcttataaattgacttcttatcagtgttgcatatttacacaaaaaaataaagcggcgctaagcgcaccgctctattttgcatactctactgcgcgagtttctcgaatgaccgtcactttaatgtgaccagggtaatcgagctcgtcctcaatccgcttacgaatatcccttgctagacggtgagcttcaagatcattaattgaatccggcttcaccataatacgtacttcacgtccagcctgtatcgcaaacgatttttcaacaccttcataagattcagagatatcttctaatttctcaagtctccgaatgtaattttcaagcgtctcacttcttgcaccagggcgtgctgcagataatgcatctgctgccgcaacaagaacagcgataatagatgtcggttcttggtcaccatggtgagaggcaatactgttgatgacaacaggatgctctttatatttcgtcgcaagctcaacgccaatttctacgtggcttccttctacttcatgatcaatggcttttccaatgtcatgcagaagacctgctcgttttgcaagctttgcatcttctccaagctctgaagccatgagacctgcaagatgtgcaacctcaattgaatgcttcaggacattttgtccataacttgtacggaattttaagcgaccgagaattttgatgagatccggatgcagaccgtgaactccgacttcgaatgtcgtttgctcacccatctcacggatataatcatcgacttcacggcgtgatttttccaccatttcttcaattcgtgcaggatgaattcggccatcctggactagcttgtccagagctatcctcgctgtttcacgtctaatcggatcaaagcccgataggataacagcttcaggtgtatcatctatgatcaagtcaatacctgttaacgtttctaacgtacggatatttcgtccttcacgtccgataatacgacctttcatctcatcatttggaagattgactacagataccgtcgtttcagctacatgatcagctgcacaacgctgtaacgcaagtgaaagaatgtttttcgcctttttatcagcctcttctttcgctcggttttcagattctttcgtcatgactgcaatgtcgtgggaaagctcattttcaacttgatccagaatgatttgtttcgcttcatctcgagttaaacttgaaatacgttccaactcggctttctgcaaacgaatcatatcatccactttgctttccatctcttcaatatgttgttgtcgttcattcagagaatgatctctcttctccaacagggactcccgtttatctaaagattcatctttgcgatcaagattttcctctttttgaagtaaacggttttcttgtctttgaagctcattacgtctttcacgaacttcttgctccgcctctactcgaaaggaatgaatttcatctttcgcttccaagagcgcttctttcttcaatgcttccgcatcacgctttgcatcctcaacaatttgttcggccatgtttcttgcgccggatatttttgcttctgcaatggttttacgaacaaagtagccaacaactaaacagattaggctcagcaaaatggagatgatcgtaaacatcgtaggcgacatattttcacctcctcttgctatgaacttggttttacaaataaagtgtcggcatgtacattgttttgagtctcaacatacagggccttcacagggaatgagatcctcactgcccttgtcaagtttaaattagttatcaatcatgttaagaaaaacaagtgatacatttccattgtaattgtgtcggaaatacttgtcaagctagtcagactgaggcgtaagtcgttatttcaagcaaagtcagaacttttgacctgctagctgtcatgtaaatgtaaaaaaaagacgcttttcagcgtctttagcatgtagacaaaccctcgcattcggtgtcaggtctgcgctccggtgctcacgaatgttgaattcgctccgctccggtactcacccttcctagacttcaaaggttttctatcacgctgaaaagaagacaaagggctaaaataaagatcattttagccctttgtcaactatctaagacgcttttcagtgtcttttagtctttaaatttccaattcctcttgaccttcttcttcttcagctgctttcactccgtttgtatccaaaccgtagtgctctctaatttgttcttgaatcatgagaagaatatctttgttttctttaaggaactgtttcgcattttcacggccttgtccaagacgttcctcttggtaagaataccaagcaccgctcttttgtacgatatctagttcgcttccaaggtcgatgatttcgccctcttttgagattccttcaccgtacataatgtctacttctgcaatacggaatggcggtgctactttgtttttcactactttaattctcgttttattccccataatgtcattgccctgcttcagctgttcagcacggcgcacttctaaacgaacagatgaatagaacttcagcgcacgtccacctggcgttgtttcagggttaccgaacatgaccccaactttttcacgaatttggttaataaagatggcaatggtttttgatttattaatggcaccagatagtttacgaagtgcttgggacatcaagcgtgcttgtagaccaacgtgtgaatcacccatgtctccttcaatctctgcttttggtacaagagcagctactgagtcaataacaacaatatcaactgcaccactacggacaagagcttctgcaatttcaagtgcttgttctcctgtatcaggctgagaaagtaacagctcatcaatattgacacctagtttttgagcgtaaactggatcgagcgcatgctctgcatcgataaatgcagcttgtcctccctgctgctgaacctcagcaatggcatgaagtgctactgtcgttttaccagaactctctggaccatatacttcaataatacgaccgcgaggatatccacctattcctagtgcagtatcaagtgctaacgaaccactcggtactgttgaaatacgtgtatctgtttgctctcctagtttcataatagagcctttaccaaactgcttttctatttgtttaagagccatatctaaggctgcttgacgatcactcattctattgtttcctcctttatcaattccactatctatactataccttgttttacgtcatttgccaagaaaaaaacgaacacatattcgattttttcttggcgaatttttaagaaaagagtgatttctagtagaaaaaacactcttttataaaggagtaaacctaacaaaaaacaaaattaactttcttttaataaattgagcaagtgatgcagaccgtatttcacagcgcgcttgcgaatgcccgaccggcttcctgtaaacatccattcaaacacgtcagtatggtctttcgtagatagcccgatgaacactttcccgacaggctgtccctcgtgggtatcagggcctgctacacccgtaaagctaatgccaatatcacttcccgtaagctttctagcaccttcagcaagctctaaagcacactctttgctgacagcaccatgagaagacaatgtttcttcccggcagccaagcacctgctgtttgactttgtttgtataacaaacgatactgccgcttaaaatcgacgatgcaccttcaagatctgtcagccattcagaaaacattccgcctgtcaggctctcagccgctgccactgttttcccgtgttcgtgcaaggcctttgaagcttcacggacaagtgaggtatcaccataaccgtagaagtactctcctacccgtgctaaaattttcgcttctgtttcttttaacagacgctccgtttctttttcatcctcatgcttggccgtgagcctaagtgttacttcaccgtcagatgcaagaggtgcaatcgttgggtttgtttgagcatcaattaaatcttctaggtctgtttcaagctgtgattcaccgattccgaagaagcgaagaacaacagacacgattttttcctttaaacccagtttctcagatatcagcggtttcgcctcgttctcaaacatcggatgcagttcacttggcgggccaggaagcagcatataaaacgtatcgttttcttgaataaacatacctggggccatcccaaaccggttcacaagcacatcagaaccttctagaacgagcgcctgcttccggttattcggtgacatgtctcgtccagtctttcgaaagtattcttgaatggattcaaacgcttcttcatttagcacgagctcttttccgagcgtactcgcaatggtttcttttgttaaatcatctttcgttggtccaagaccacctgagaagataataaaattcgatctttcctgcgccacttgaatggcgctttttaaacgctctggattgtcaccaactgctgtatggtaataaacattcacaccaatttcagctagctgtttgctgatgaattgtgcattcgtattcgtaatttgccctagcaaaagttcggaaccgactgcaataatttctgcttttctctctgacttcaaagcgtacacgtcctttttagttagaattctttaaagcttcccagtttttcacaaagtaatcccagcctgacacaacagtgaagaacactgctacccacatcgcaaggtcaccaaacgggaatgatacaagttcaaacggaaggttatgcaagagaagggctgaaatcgcaatgatttgcgcccatgttttcactttaccaagcatattagctgctaccacttcaccgcctccggctagtacaagccttagaccagttacagcaaattcacggctaatgatcacaatcgccatccatgccggcgtgaggttgtactgaacaagtataattaaagcagctgaaacaagcaatttatctgcaagcggatctaaaaatttaccaaaattcgtcactaagttcagtttacgcgcatagtacccatcaatccagtccgttgtcgaagcgacaataaacaggattgctccaacaagatgcgtcacttcgatgctgacgtgaccaaaacgcgcaacgccccaatctaaaggtgcaagcataatgatcataaaaacagggatcaaggcgatcctagaaagagttattttattcggtaagttaaacatgaatttcaatcctccaataagccatttttttatgtatataatagtaggaacaaaagaaaagtcatctacttgcttaagatgacttttcctttcctttattcacaatcacaatgttttgtgtcatggtgttcttagggtctaattcgtactttagcgtctcgtcattcaccttaatatcaattccagtcgcattgcctagacggatatcgacctgagagagctcagacaggtctgttttaaacgattcaccatcttttagttcacccattttcagcacttttccagattcgtctctgacgcgcagccatgaagcttttgtagcagaaatggttaactccatctcatctgcgcctgacgcttcatacgttgtcgttgagccttctgtattcgctgccttcaaagagaccgtttcatcgtctttggatgaatcctttgatgagtcatcttttttagatgatttttcttgatcatctgacggagctttttcttttttcttttgatcttttgcaagagatgaatcctcagatacttcatacttagattctgacttctgaggagccgtctggttgttcttctgtccgctatcatgattgaccgcctgcacgatgacataaatgatcgcgatgaccacaaggacgcctccaataaccaaaatggtcggcagcagctcaagcaccttcgaggcaggctttggcagctctctttgcggcttaatatttgataatttatcagatacttcatcgttatacgtgctcggcacatctttacgaaattcttcgaacaattgttcaggatttagtccaacggcttcggcatattgtttaataaacgctctgacgtaaaatttacctggaataatatcatagtttccttgttcgattgctagcaagtagcgcttttggattttggtcaccgtctgaagatcctccagcgacatccctttttcctctctggcctcaatgagccgttttcccaattcagtcaaaacaaacacctaccattaccatattaaaaatcgaagccagaaaaaccagaatgatcaaacacttgtggttcttcagcgtgctcatatgtaatctcttcgtctgcactattacgcaattcaatgatatagtcgaaatcatccattgtatattctgaattttgaataaagatgtctggatgctcaactacttttgttgccggcagtctcataatttctcttaaaagctgcaagtgcttctcagaacctcttcgcgtcgacacaatcccatcaataataaagacgttatctgggctgtattcatccgcaatcagctgacttcggatcgtctgtttcaaaagagtggacgatacaaaaagccatctcttgctggcacatacacttgaagccacaattgattctgtttttccgacacgcggcatcccgcgaatcccaatcaatttatgtccttcttttttaaatagttctgccataaaatcaacaagaagaccaagctcgtctctttcaaatcggaacgtctttttgtcatctgcatcacgctgaatatatctgccgtgacgaaccgctaagcggtcacgtagttttggctgtcttaatttcgttacttttatcgtttccattgtatttaaaattgattcaaggcgcttaatttgatctgtatggtcacagcgcagaagcattccgcgtcttgatacatcaacaccattaattgtcacaatattaattgaaagcatccccattagagatgaaatgtctcctaaaagtccgggacggtttacctgtatctcatattcaaaataccattcgagctttgccaaatgatattacccccttcattgtggcaaatttttaccttcctatatcataaagcattttcacatttttagaaagcacaatgttgtgaaacagttaaaataaaaagagaggcacaaacgacctctctttttgtttagtgcgagctattattttcaaccaatttgaccatcatattggcaattgcgcgctgctcatcttctgatgcaacgctccaaaggtcagcaagtactctttcttgctcgttctttgcttcaacttcgttagctaaatatccgccaatttcatacgcaaggttattgatggtatcatcttttaagcctttatcctgcgcatgatttaaacggtcacctaaaaagtttttccaatggtcccagttctcaagtactgacatgtcgattcctccattcgaaaagatgaattacagccatagcttttgtcatggagtgatgaattatacacgttttttaacagtaccagccgccattaacggataaaacttgacctgtcatataacttgactgctttgaggcgagaaaccaaatgacatcagcaatctcctcaggtgatgcaagccggccaagcgggatttcttcctccagcatgtcaatatcttcttgtgtgaagcttttcatcatgtctgtatggacggcacctggtgaaacagcatttgctctaattccacttggggcaagctcttttgccagacctttaataaacgcattttgcgcgcccttcaccatgctgtacagcacttcacacgatgcccctgtttctccccatatcgagcttaccgcaacaatatgacctgcttttttttgaatcatggctggcaataggtgttgggtgagctcatatggacttgtgacatgaagctgcaccatactggctaatacgtctttttctgtatctgtcactaatccgacatgactcttaccgctatttaatacaagaatatctggagatacggccagacggctgacgagctcatctgctccgcccgttttagctaaatccgcttgaacgacatgcgtctgaatatgacatgtttcttccagctcagcggcaagctgcacggctgcctgttcatttttgtgataatggagcatcacgtggcagccttcctgggcaagccttttggctgcagcctgcccaatcccgccactggcacctgttatcagcgcccaacgactcatcacatggattcctactttctatttaaaatatctattctttccgtttaaatgggaaccagttcgctgatccgaacaatttcaccatcacaggtacgaacaatggtagcacaacgagtgcgtacagcaaaagccctgtgaggacaagtgttgcaatctgcaagagagacagcactcctgaaggaagcatggctgcaaatgttcctgccaaaataacagcagcagacataatgacagagcccatattcttcattgattcagtcatcgcaaactgaatgtcttttgttttgtattcattgaaccgctccattaagaaaatcgaataatcgactccgagcgccattaatatgacaaatccaaagaatggaaccgcccagttaatgcccggatatccaaagaaatgggtgaaaataaattctgtgacaccaatcgcagtgaagtacgtcaaaatcagcgatccaactaagtaaagcggcataacgagagaacggaacagaatcacgagtatcaggaaaataccgatcatcatgtaaagaactgtcttattgaagtcttggtctgacagctgttttaaatcagcgttcatacttgatacaccagatacgccaaatgaaacatcttttagatttgtttcaggaagtgcacgttttaccgaagcttctacttgtttaatcgttttcatggcgtcgttcccatattgattgttttctaaaatgacgtcaatctttgtcatcttgcggtcatccgacatataggaatcgaacacttgcttgaatgctttatttttcaggacatcttttggaataaaccaaccggccatgtcttgatctggtgcattttttagttcgtctaagtagtcacctgcacccattaatccgcttgaaatcttctccaagccatcgacgcttttgttcagtccatctgtcagtttggttaggtcatcaccaaagccgccaatcttttctttcatttgtttttgaccatcaatcacttgcccggcaccatttgcaagctttggcatattatcagctatttgcccttgacctttagacgttttatccaatcctgtttcaattgcatctaagccagcaatgagttcatcgatttgactcgtcaaaactttttgctgctctgaagcttttgcgatgaaggcatccgctgcttcaagctgttttctagcttctttcgcttgtttggcatagctgtctgcctgcttcgccccttcttgcaaggtcgtagaaagttcattatatgaagctttgatggcttgatacgattgattttctttcacctgcggaatttgtttttcaagtgtactaaattgtttatttgcttgtgtgattaatgcttttacatctgctgcggcagaggatgacgtatccacctgcgccaatgctgcttttaattctttggagatgcttttatacagcgacacttgctgattcacttgtgcgacttgagctgttaattcctttttcgcacctttaattttctctttaatctgtgcaacaccgtttttgttttgatcgattccgctttgtaaatctcttaacgacttttcgacgttttgaatgcctgtttgcactgattctgtaccagaaatcaatttgttaatgccttttccagatgatttgatttgcggcgtttgatcctcaatggattgactcattgtcgtcagtgcatcttggatctttttcaacccttcattacttttatcaagcccactatttagctctttggcttgagatttcacgtaaagatcattcagtcctttaccaacaggacgtgtggcacttctcactttactcacgccatctgtttgttcgatcgcgcggctaagtttttcaatagcaatcaggcctttgttattgtctaaaagatcagatgattttaccacaactgttgctggaagggcttcacctggtccaaatttgtcagagatggtattgaacgcattgacggattcgtatttattgccgatttcgtcaaggttgttatatgaaagtgtccctttatacatgagaatcggcggaagggtaatgattgcaacgattagcaagctgaaaagtggtttcttaaatgaaaaacgacctgctgtttcccacattttcgattgcgggtgagcaatatctcctttaatcggccagaataacacttttcctaaaaccgccataaagaatggaacgaccgtgaggagtgccacaattaacacggcgacaccaactgccactgctacagctgatttatacagttggaattgggctaaaccgatacacgtaaaaccaatgaggacagcaattccgctgaataaaacggttttacctgccatcttatatgttgtaataatggcctcaatcttatcttttccatgagatagttcttctttaaaccggcttagcaataagatgcagtagtcggtaccaatcccaaacatgatggcgaccataaaaatttgggtaaaggtcgagagcggaaaatcaacatactttactaggtaagccacaatcgattggctgattaaataagaaagcgccactgccactaaaggaacgaatggtgctactgccgatctgaagacaagcacaagaacaattaaaataaacccaattgtaatgaattccgtttttttcagaccttcttgcgagcttgtgatgacatcatcgtcgatcagcggctgccctgtcatttcaaatgttaggttcagactctttagcttttcattgactctttctttaaaatcggatgctttgattttgttcgagtcgtatgtaactggaacaagaagtgttgtttgatctttagagagcatctgttttttgatatctttgtttgcatcaaaataagaagtgatgtcttccacatggaggtcttgatccttttctaatatctccatcgctttctttaaagaggtttctctttctttaacgatatccttaccttggaagactatgacgatcgatttctctgtatccccatttttagacatgttctttaataattgatcggcgtaggaagaaggataaccatcaggaacagaaatttgccctttttctttagttaattgcgccatattaggagcggtgatgagtaatactgccgctagtacgacccagaggatcgtgatcagccatctaccttttatgattgctctcattactatgttgtgcctcctcttcgatgataatttgataaatcttttcatatgtttgaataaatgattcgatttccttttcatcaaacttttctaaatatgaccgaacaagatcctgaagctgcttctccattcggctgaccacgtcttttccttcgggcgtcacatagagatgaacgtttcttcgatcaacttgatcatgctctcgataaatataatctttattaaaaagacgattggtcatggatgtcacagcacttttattgacattacattcgatggcaaggtctgttgatgtacatcctgggtgtaagttgatgtatcgaagcgagtaatattgatcaagtgtcagttctttatccagcttttccgtgatcatactcgatacttttttctccatcatgagatagacgtccgcatatctctggatgagctgtgcaattttattttgtaccatatgctgctcctttagtttgattgtttaactattaaagagtttaactaattgccaaaacaattgtcaatcaataccctcacatataaagcgctttctttcgttggacacaaaaaagacaaactcttatacgttgagtttgtcttttttcattttattttgttttagggacaactttgaaaacggacatccgttcttcatcaatttcttcttctaaaatgtgctgaatgtcggttaattggatctgttccagcatagtcacgacatcaaataagctcatgtctaaaaatgcatatcgagtgaattggttcgcaatgtattcaggagaattcatggcttttaaaaagctgccgattttcttcttgcgcgcgagctcaattttctcttctgagattaagttctttgcttgaagaagggtttcttttaatactttcgccagttgatctggatcatttgtgtctccgccaactgacgtgaagccaaagccgccttcttccgtataatcgtagctgaaggtctcatcaattaagcctttttcatacatctgttcatattgtaaggagcttttaccaaacagcgtctctaaaatgagattcattccgagctcatgttttaacagttcattgccttttttatgaggattctttgtttttaatccaaacatacatttcgagccttgtacgttcattggaagttcgtattcttttcggtacacaccttcaggctcattgatgtcttttcgtttgatctctggctggtctgtaaatggctttttcgcctgattcgctcgaacttgatctaatatttgcttcggatcaacgggaccgacaacaaatagaagcatattgcttgggtgatagaacgtttcatagcattcatacaaatgatcttttgtaatcggagcgatgctttctactgttccagctatatcaattctcacaggatgctcttgatatagattttcaatcagaccaaagaataaacgccagtcgggattatcatcatacatgttaatctcttgaccaatgattcccttttctttttcgaccgttttttcagtaaaataaggttcttgcacaaaatcaatgagtgtctcaaggttttgttcaacatttgaggtgcttgagaataagtaagctgttctcgtaaatgtcgtaaaagcatttgcggatgctccttgtttactaaatgtatgaaatacgtctccatcttctttttcaaacagtttatgctctaagaaatgggcaattccatcaggcacccggatcatgtcttctttgccaagcggcacaaattcattgtcgacagaaccgtattttgttgtaaaggttgcataggttttgttaaacccttgctttgggagcacatagacgtcaagtccgctctccattttttcgtgatagaccgtttcttggagctggtcgaattgaattgttttcactgtcatgaagcaccctccgttcctttaagaaaataggtcgtatcccattcgattttctgacccactttgatgatgtcctcttttgtcactcggtcaagtgcttctaaaaaggaatcaagcgtttcccctgttggcacaacggcatgctgatacaggtattctgctgtcccataagatgtatcgatcgtttcaagcagctgatttttgacgacagctttagtttggtcaatcgcttcatctgaaaaatcacctttttgcatcgcttcaaattgttctttaatgatgtctactgcctgctgatagttgccgacttcaatccctgacatgaccatcatcaagcctttaaagctctcaagtctagacacagcatagtacgcaagacttgctttttcccgaacattgatgaatagcttcgaatgcgagaagccaccgaatatgccattaaacaaatgcaaagccggataatcgtcatctgcaatcgtcgtatgcgtgcgaaagccgatattcagcttgccttgtttcacgtcctcttcgtcgatgacttcttttgcttctctttgcgtgcttgccgattcagcatgttgtttgaccggttctctatcacttgttttgaagtattgagagaccattcggctgatgtcttgttcgtctacatctcccacaacataaagatcaagctgatttgtttgaagcgcatgcttatatgcttcaaacagcgaatgagctgtgatcgtttcgatatcttccatttctccattaacgtgcagcgcatacggttcacctttgcacatttcctgcacaagccttaagttcgagtaacgcattttatcatcatacactgcttgaattcgctgttttaaagtgcgcttttcttgatctacatataattgactaaacgctccatcttcaacatacggatggaatagtagatcagatagtaaggcaatccctttttctagtaaaggggtttgatcctttaaatatttttcattcgccatttccaggcggaaggtaatgatgtgattctccccttttttcgccatgtctgccgaaacagttgcaccataaagctcatcaaaataagcacgtaattctcctgttttcggcattttctctgttcctcttaacagcacatgcgggaaaagtgaacgcatggtgacgtcatctttcgatagaggcgcaagcattttaaaaaggattgtgaccgttttaaatttttctgttttgacaatatgagtatgaagaccaggtgtgtctagtgtcttctcttgtaagtacgtcatgagaaacctcctttgttcatcctatttattatgtattagaacatagctgatatatacgtaaaacagccatttaatagacattatatcaatcagaggaaaggataggaaataaaaacgcctctgctatcagcagagacgccggtcgttatttcattctaaaaggccaccaattccatttaccgaaaatacgaaccatgaccgggataaagagcggtaatacaacaaaagcatataataaaagcccaatgagtatgaccgttgcaatttcaacaagtgataatacaccggatggcagcatagcggcgaaggtccccgctaatatcgcgactgctgaaataatgacagaacccatatttctcatcgctgatatcatggatgcttgcacatgttctcccttccattcattaaagcgatccattaggaagatcgaataatcaatgccaagggtgacaagaatgacaaagctgaaaaatgggacagcccagctgagaccgtcgtagccaaaaaatgttttaaagatccattctgttaaaccgacggatgtaaaatacgttaaaatgagtgaaagtgttaagtatatcggcatgacgattgaccgtaataatataattaaaatgataaagatgccaactaacatgaaaatgaccgttcgaataaagtcaccgtcagatgtttcttttaaatctacatttaaacttgagataccagacacaccgtaatttgcattctttaacccgctgacaggtaaatattgatcaagggtttcctcaatttttgcaacgcctttcatcgcctcattgctgtatggattcacatttaaaataacttctaaggttgttaatttacgatctggagacatatacgtttgaaagatttgtttaaattcatggcgtttcagcacttcttctggaataaaccagcccgttatttcttcatctggcgcttgctgaagctgctttaaatagccgtccgcctctgtgaagccgcttttgacctgctcgagcccttcaatgctttcacctaatccatctgttaataatgtcagttttgatgaaagctggttaaatccttttttgatggctttttgtccgcctgtcagttgatctgcgccgtcttcaattttaggcatttctttgatcaattgtttttgtccttcatttgtttgatcaagaccggcataaatttggtccagcccctccatgagcgctcgcacttgatgttttacttctttttgcttgcttgaaaagctttgaatcactgaatctgcttttttaatcttttctttaaacagagaggcttcctcttcatacagactcatttgatcccctgcttgatcaagcattccttttgtgtctttgaatacttccttgatttctttatattcatccatatcttttacttcaggaagccgtttttcaagtgcttcaaacgatacactttcatacgaactttttacttttttaatggtggttatcagctgctgatttgatttcgcatgacgttctagcgtactcaccattcgtttaagctcttgaatcatcgcttcactgctgcgatattcttgctctaattccttttttgcttttttgattttacttcggatggtcccgacaccatctttactgcgcctcaccccatcttctaaagagatcagggactcccttacttctccaatgccgcttttgatcgcttttgttccatcaatcagctggtcaatgcctttagcggattcttgaatttttggtttttgtttaagaagggcaagatttgtttcagtcaaaccatctgaaatttttccgattccttcatggcctttaccaagttctcctcccagctcttttgcttgagaggtgacgtaaagctgacttaacccatcaccaacaggacgagtgacactgcggaccgtctttacttcgtcaatgtcatttaatttacgggttagtttttcaatcatgacaatcttttcttggttatctaacttgttgtcactttcaacaagtacattcaggggcagcgcttccccaaagccaaattgctctgatatcgtattaaatgcagacactgattcatactttgtcccaatctcatttaagctgttataagaaagagtcccgtcgtacatcaaaataggaggcaccgtaatgagtgcaactaaacctaggctgatcagcggccttttaaatgaaaaacgcccagcccattcccacattttactttgcgggtggcgaatgttttctcttttagacggccagaaaagggattttccgaaaacagacataaaaaagggtacgatggtgacaagagcgatcagcaggatgccaactcctacagcaacactaacagctgattgatacaattgaaatttggcaaacccaatgcttgagaaaccgactaatacggctaagccgctgaaaaggaccgttttccctgcacatttatatgtgatgataatcgactctttgacatctcgaccttgaccgatttcttctttaaaacggcttaacaacaaaatacaataatctgttcctataccgaacataatcgctaccataaaaatctgagtaaaattagatagaggaaattgcatatattctactagaaaagccacaatacaacggctgacggcataagaaatgccgatcgtaataagcggaacaacaggtgccaaaatcgatctgaaaacaatgattaaaataaagaaaataaaaatgatcgtgataagttcagttttcttcagaccttgttgagagctttgaatgacatctgaatccacaaatttttgtcccgtcatttcatatgagacatgatagggctttaaaacttcctcaatttgttctttaatcttcacagcttttgtttcgtagtggtcgaatttgaatggaacaagaagtgtacttttatcctttgataaaagttgtttttgaatgtccggatctacatgaaaatacgaagtaattccgtcaatgtggaggtctggagcatgtgtcatgagtgcagataaagccttttttagttcctgctctttcttagggaatagatgttgttcggagaatacaatgacacccgtatcttttttcccgttttgatctgtgagcttatccaataattgaagtgcctcagctgttggtgtcccctccggaacctttaattgccctttttctcttgttaattcctctaaattgggcgcagtaataaacagaatcacagctgttatcacccacaccactaatacaatccatcttgctttaattatttgcaacatagctgcttcaagctccttctagttcatcaatcaatttgctgtttttgagcgtgtctgaagtgctgactgcgtctccttcaacgtgctaatggcaggatgacctattcaattgtcttttcgtgttgaagaaacacacattcatcatcaccacgcgaactcaatttctgcctaaagaaagacagaaaatgaatgtttttgaacacctcctgtttggaataatttaaaagatattactatacattagtttaactatcaaaattttacatgtcaatttataaaaaagaaaaaagatggcaaaataccgtcttttttctagattaaaccgtttttaattgttcactttcatcctcttcatctggctggatgaagaagatgaccaaaaatagagaaataagactgcaaatggtcgagaggataaaaacaatggagtcccctttatccatgagataagcgtaaatcggtggccctaaagcgacaccgataaaacgcatactgctgtaaaacgacgtaatggttccgcactgctctttttcaattccttctgtgatcagggcatctagtgcaggcagtacaataccgatgccaacaccgccaatacttaagcagataaacaatacgtaaaagctgtgattccaccataaaaacatataagaaagtgataacaaggccattcctacgattaaaaagattctcattttccctttttcttctccaatcgttttcccagcaacgtatgagctgatggatagaaaaagaagcggaatgctaagcaggagcccttttttgacacccttaatttgataagctgcctctaggttatcagataagtaaaaaagcacaccaaaaagaagaaacataataaaaccgccaattgcaaaaatggcatacagccagcgtccctcatgcttaaatatggtctttgttgattttaaaaattctttaaatgaaggcgggtcctcctctttttccgcggactctaccatgaacagtaccatgagaaagctgatgattgagaagaacggaataaaccaaaacggcacaaaccaaaaccatgaagccaaaagcgccccaataatcgggctcaatacctttccagctgtgttagaggtttcaatggcgcctagtcccgcactgacttcttcatcatcatgaaacaaatctccaataaacggcatcacgacaggtgctgccccggctgacccaacaccttgtaggaccctgccaaatagaatccacatgtacggctctttcatgatcgttgaggcaactgctgccacagcccctccaagtcctgcgattaacagacacggcaggagtaccttttttcgcccgattcggtctgataaatagccggcgatcggaatacataagatcgcgacaacggag
